(12) United States Patent
Joyce et al.

(10) Patent No.: US 12,534,743 B2
(45) Date of Patent: *Jan. 27, 2026

(54) COMPOSITIONS, SYSTEMS, AND METHODS FOR GENOME EDITING

(71) Applicant: INARI AGRICULTURE TECHNOLOGY, INC., Cambridge, MA (US)

(72) Inventors: Adam Patrick Joyce, Stow, MA (US); Michael Andreas Kock, Rheinfelden (DE)

(73) Assignee: INARI AGRICULTURE TECHNOLOGY, INC., Cambridge, MA (US)

(*) Notice: Subject to any disclaimer, the term of this patent is extended or adjusted under 35 U.S.C. 154(b) by 826 days.

This patent is subject to a terminal disclaimer.

(21) Appl. No.: 17/810,023

(22) Filed: Jun. 30, 2022

(65) Prior Publication Data

US 2022/0372524 A1    Nov. 24, 2022

Related U.S. Application Data

(63) Continuation-in-part of application No. 16/557,581, filed on Aug. 30, 2019, now Pat. No. 11,479,762.

(60) Provisional application No. 62/725,910, filed on Aug. 31, 2018.

(51) Int. Cl.
| | | |
|---|---|---|
| C12N 15/90 | (2006.01) | |
| C12N 9/22 | (2006.01) | |
| C12N 15/11 | (2006.01) | |
| C12N 15/82 | (2006.01) | |

(52) U.S. Cl.
CPC ............ *C12N 15/907* (2013.01); *C12N 9/22* (2013.01); *C12N 15/11* (2013.01); *C12N 15/8213* (2013.01); *C12N 2310/20* (2017.05); *C12N 2310/531* (2013.01); *C12N 2800/80* (2013.01)

(58) Field of Classification Search
None
See application file for complete search history.

(56) References Cited

U.S. PATENT DOCUMENTS

| | | | |
|---|---|---|---|
| 8,697,359 | B1 | 4/2014 | Zhang |
| 8,771,945 | B1 | 7/2014 | Zhang |
| 8,795,965 | B2 | 8/2014 | Zhang |
| 8,865,406 | B2 | 10/2014 | Zhang et al. |
| 8,871,445 | B2 | 10/2014 | Cong et al. |
| 8,889,356 | B2 | 11/2014 | Zhang |
| 8,889,418 | B2 | 11/2014 | Zhang et al. |
| 8,895,308 | B1 | 11/2014 | Zhang et al. |
| 8,906,616 | B2 | 12/2014 | Zhang et al. |
| 8,932,814 | B2 | 1/2015 | Cong et al. |
| 8,945,839 | B2 | 2/2015 | Zhang |
| 8,993,233 | B2 | 3/2015 | Zhang et al. |
| 8,999,641 | B2 | 4/2015 | Zhang et al. |
| 9,790,490 | B2 | 10/2017 | Zhang et al. |
| 9,896,696 | B2 | 2/2018 | Begemann et al. |
| 11,459,551 | B1 | 10/2022 | Joyce et al. |
| 11,479,762 | B1 | 10/2022 | Joyce et al. |
| 2015/0059010 | A1 | 2/2015 | Cigan et al. |
| 2015/0082478 | A1 | 3/2015 | Cigan et al. |
| 2015/0344912 | A1 | 12/2015 | Kim |
| 2016/0138008 | A1 | 5/2016 | Doudna |
| 2016/0208243 | A1 | 7/2016 | Zhang et al. |
| 2018/0187176 | A1 | 7/2018 | Behlke et al. |
| 2020/0263190 | A1 | 8/2020 | Zhang et al. |
| 2022/0348910 | A1 | 11/2022 | Gonatopoulos-Pournatzis et al. |

FOREIGN PATENT DOCUMENTS

| | | |
|---|---|---|
| CN | 113604608 A | 11/2021 |
| WO | 2016166340 A1 | 10/2016 |
| WO | 2018208755 A1 | 11/2018 |
| WO | 2021154866 A1 | 8/2021 |
| WO | 2022159402 A1 | 7/2022 |

OTHER PUBLICATIONS

Extended European Search Report in EP22182278.6, mailed Dec. 15, 2022, 12 pages.
Gonatopoulos-Pournatzis et al., "Genetic interaction mapping and exon-resolution funtional genomics with a hybrid Cas9-Cas12a platform," Nature Biotechnology, May 2020, vol. 38, pp. 638-648.
Jedrzejczyk et al., "CRISPR-Cas12a Nucleases Function with Structurally Engineered crRNAs—Synthetic trAcrRNA," Research Square, Oct. 21, 2021, 30 pages.
Zetsche et al., "Cpf1 Is a Single RNA-Guided Endonuclease of a Class 2 CRISPR-Cas System," Cell, Oct. 22, 2015, vol. 163, pp. 759-771.
Sternberg et al., "DNA interrogation by the CRISPR RNA-guided endonuclease Cas9," Nature, Mar. 6, 2014, vol. 507, No. 7490, pp. 62-67, 18 pages.
Gier et al., "High-performance CRISPR-Cas12a genome editing for combinatorial genetic screening," Nature Communications, Jul. 13, 2020, vol. 11, No. 1, pp. 1-10.
Bandyopadhyay et al., "CRISPR-Cas12a (Cpf1): A Versatile Tool in the Plant Genome Editing Tool Box for Agricultural Advancement," Frontiers in Plant Science, Nov. 2020, vol. 11, Article No. 584151, pp. 1-18.

(Continued)

*Primary Examiner* — Manjunath N Rao
*Assistant Examiner* — Jae W Lee
(74) *Attorney, Agent, or Firm* — McKee, Voorhees & Sease, PLC

(57) ABSTRACT

This disclosure provides compositions, recombinant expression constructs, and engineered systems that include a polynucleotide including or encoding a Cas12a tracrRNA, and methods for their use. The materials and methods of the disclosure are especially suited to sequence-specific genome editing of eukaryotic genomic sequences.

17 Claims, 14 Drawing Sheets
Specification includes a Sequence Listing.

(56) References Cited

OTHER PUBLICATIONS

Teng et al., "Enhanced mammalian genome editing by new Cas 12a orthologs with optimized crRNA scaffolds," Genome Biology, 2019, vol. 20, No. 15, pp. 1-6.
Dai et al., "One-step generation of modular CAR-T cells with AAV-Cpf1," Nature Methods, Mar. 2019, vol. 16, pp. 247-254.
Partial European Search Report in EP22182273.7, mailed Dec. 21, 2022, 15 pages.
Oh et al., "Multiplex gene targeting in the mouse embryo using a Cas9-Cpf1 hybrid guide RNA," Biochemical and Biophysical Research Communications, 2021, vol. 539, pp. 48-55.
International Search Report in PCT/US22/73286, mailed May 11, 2023.
International Search Report in PCT/US22/73281, mailed May 11, 2023.
Begemann et al., "Characterization and Validation of a Novel Group of Type V, Class 2 Nucleases for in vivo Genome Editing", bioRxiv, 2017, pp. 1-9, https://doi.org/10.1101/192799.
Burstein et al., "New CRISPR-Cas Systems from Uncultivated Microbes", published as Nature, 2017, pp. 237-241, vol. 542, No. 7640 doi: 10.1038/nature21059.
Cong et al., "Multiplex Genome Engineering Using CRISPR/Cas Systems", Science, 2013, pp. 819-823, vol. 339, No. 6121.
Di Tomasso et al., "The ARiBo Tag: A Reliable Tool for Affinity Purification of RNAs under Native Conditions", Nucleic Acids Research, 2011, pp. 1-10, vol. 39, No. 3, e18.
Hendel et al., "Chemically Modified Guide RNAs Enhance CRISPR-Cas Genome Editing in Human Primary Cells", published as Nature Biotechnology, 2015, pp. 985-989, vol. 33, No. 9.
Kieft et al., "A General Method for Rapid and Nondenaturing Purification of RNAs", RNA, 2004, pp. 988-995, vol. 10.
Lee et al., "RNA-protein Analysis Using a Conditional CRISPR Nuclease", Proceedings of the National Academy of Sciences USA, Apr. 2013, pp. 5416-5421, vol. 110, No. 14.
Leppek et al., "An Optimized Streptavidin-Binding RNA Aptamer for Purification of Ribonucleoprotein Complexes Identifies Novel ARE-Binding Proteins", Nucleic Acids Research, 2014, pp. 1-15, vol. 42, No. 2.
Park et al., "Extension of the crRNA Enhances Cpf1 Gene Editing in vitro and in vivo", Nature Communications, 2018, pp. 1-12, doi: 10.1038/s41467-018-05641-3.
Parrott et al., "RNA Aptamers for the MS2 Bacteriophage Coat Protein and the Wild-Type RNA Operator have Similar Solution Behaviour", Nucleic Acids Research, 2000, pp. 489-497, vol. 28, No. 2.
Ran et al., "Genome Engineering Using the CRISPR-Cas9 System", Nature Protocols, 2013, pp. 2281-2308, vol. 8, No. 11.
Shmakov et al., "Discovery and Functional Characterization of Diverse Class 2 CRISPR-Cas Systems", Molecular Cell, 2015, pp. 385-397, vol. 60.
Srisawat et al., "RNA Affinity Tags for Purification of RNAs and Ribonucleoprotein Complexes", Methods, Feb. 2002, pp. 156-161, vol. 26, No. 2.
Invitation to Pay Additional Fees in PCT/US2022/073286, mailed Mar. 14, 2023, 12 pages.
Extended European Search Report in EP22182273.7, mailed Mar. 13, 2023, 16 pages.
Wang et al., "A microRNA-inducible CRISPR-Cas9 platform serves as a microRNA sensor and cell-type-specific genome regulation tool," Nature Cell Biology, Apr. 2019, vol. 21, pp. 522-530.

LbCpf1 putative tracr 1 (19/36=52.8% identity)

Tracr 1 (84 nt)  5' ACTTATACTAAATTTTAACTGTATACTTTCCCAAAATACCATAGGCTCTCTGAATCTCTTAACCCAGATTCCAAGGGCTTTTTT 3'
                      |  || |||  |    ||  |  |  ||  |  |      |||
DR (36 nt)  5' ATCTACACTTAGTAGAAATTATTTAATCTTTGAAAC 3' (Reverse Complement)

LbCpf1 putative tracr 2 (18/36=50% identity)

Tracr 2 (65 nt)  5' AATTGCAAATCTTTGAAATAATGCAGACTTAAATTTATAAATTCATGGAATAAGGTGATTTTATT 3'
                     |  |  ||   |   |  ||||||  ||   |    |||    |
DR (36 nt)  5' ATCTACACTTAGTAGAAATTATTTAATCTTTGAAAC 3' (Reverse Complement)

Figure 3

AsCpf1 putative tracr (18/35=51.4% identity)

Tracr 2 (72nt)  5' CATTGTCTAACCTGCAAACCTCCAACTTACTATTGCTAAGGAGTATATATTTTGTATAAAAGGTCTTTTTTC 3'
                                                  |   |  ||    |  |||||||||||  |
DR (35 nt)                              5' ATCTACAAGAGTAGAAATTAAAAAGGTCTTTTGAC 3' (Reverse Complement)

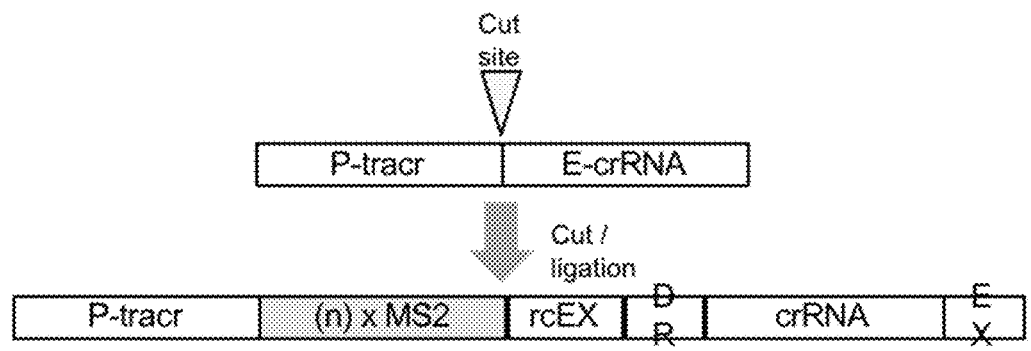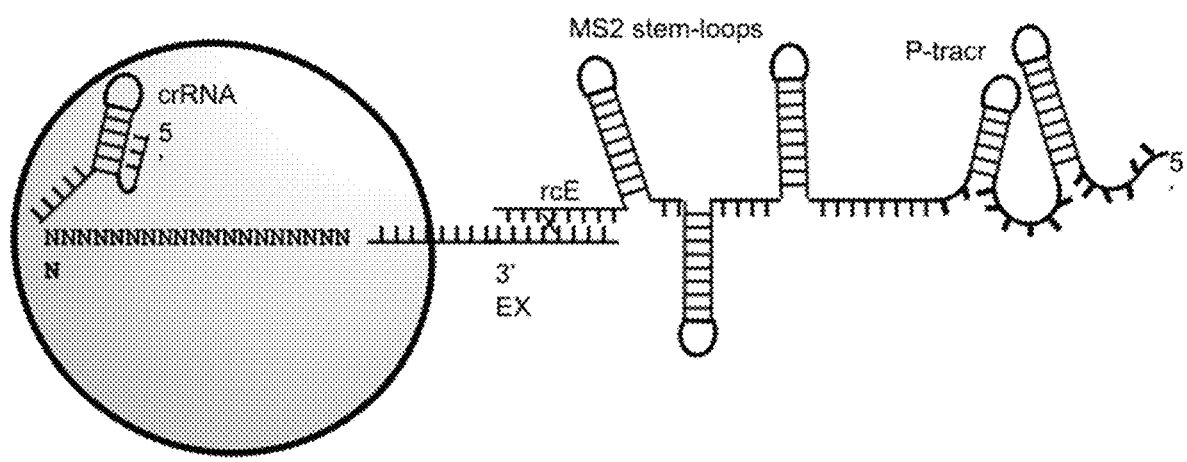
Figure 11

COMPOSITIONS, SYSTEMS, AND METHODS FOR GENOME EDITING

This application is a continuation-in-part of U.S. patent application Ser. No. 16/557,581 filed 30 Aug. 2019, which claims benefit of priority to U.S. Provisional Patent Application No. 62/725,910 filed 31 Aug. 2018, which is incorporated herein by reference in its entirety.

INCORPORATION OF SEQUENCE LISTING

A sequence listing containing the file named "10015US03 V2.txt which is 738,485 735 bytes (measured in MS-Windows®), comprises 243 biological sequences, and was created on-Oct. 24, 2022, is electronically filed with the USPTO, and is herein incorporated by reference in its entirety.

FIELD

Aspects of this disclosure relate to biotechnology, in particular compositions and methods for genome editing.

BACKGROUND

Recent advances in genome editing technologies have provided opportunities for precise modification of the genome in many types of organisms, including plants and animals. For example, technologies based on genome editing proteins, such as zinc finger nucleases, TALENs, and CRISPR systems are advancing rapidly and it is now possible to target genetic changes to specific DNA sequences in the genome.

CRISPR technology for editing the genes of eukaryotes is disclosed in U.S. Patent Application Publications 2016/0138008A1 (now U.S. Pat. No. 10,227,11) and US2015/0344912A1, and in U.S. Pat. Nos. 8,697,359, 8,771,945, 8,945,839, 8,999,641, 8,993,233, 8,895,308, 8,865,406, 8,889,418, 8,871,445, 8,889,356, 8,932,814, 8,795,965, and 8,906,616. Cpf1 (Cas12a) endonucleases and corresponding guide RNAs and PAM sites are disclosed in U.S. Pat. No. 9,790,490 and U.S. patent application Ser. No. 15/566,528 (national phase of PCT Application PCT/EP2016/058442, published as WO 2016/166340), now published as U.S. Patent Application Publication 2018/0282713. Other CRISPR nucleases useful for editing genomes include C2c1 and C2c3 (see Shmakov et al. (2015) *Mol. Cell*, 60:385-397) and CasX and CasY (see Burstein et al. (2016) Nature, doi:10.1038/nature21059). Plant RNA promoters for expressing CRISPR guide RNA and plant codon-optimized CRISPR Cas9 endonuclease are disclosed in U.S. patent application Ser. No. 15/120,110, published as U.S. Patent Application Publication 2017/0166912, national phase application claiming priority to International Patent Application PCT/US2015/018104 (published as WO 2015/131101 and claiming priority to U.S. Provisional Patent Application 61/945,700). Methods of using CRISPR technology for genome editing in plants are disclosed in U.S. Patent Application Publications U.S. 2015/0082478A1 and U.S. 2015/0059010A1 and in International Patent Application PCT/US2015/038767 A1 (published as WO 2016/007347, claiming priority to U.S. Provisional Patent Application 62/023,246, with U.S. National Phase application U.S. Ser. No. 15/325,116, now published as U.S. Patent Application Publication 2017/0306349).

U.S. Pat. No. 9,790,490 and Zetsche et al. (2015) *Cell*, 163:759-771 teach that a tracrRNA is not required for nuclease cleavage activity of Cpf1 (Cas12a) effector protein complexes and suggest deletion of such sequences from engineered genome editing systems. This disclosure demonstrates that the presence of the tracrRNA as such has a beneficial effect on Cas12a editing efficiency and that the tracrRNA can be usefully employed in genome editing.

SUMMARY

Disclosed herein are polynucleotides, DNA expression systems, compositions, and methods of use thereof, useful for genome editing.

In one aspect, the invention provides a method of tethering a functional RNA molecule to a Cas12a crRNA, the method including hybridizing (a) a functional RNA molecule including a Cas12a tracrRNA and a functional RNA moiety; and (b) a Cas12a crRNA that includes a 3' extension capable of hybridizing with a segment of the functional RNA molecule; thereby tethering the functional RNA molecule to the Cas12a crRNA. In embodiments, the functional RNA molecule is transcribed from a DNA molecule that encodes the Cas12a tracrRNA and the functional RNA moiety; in embodiments, DNA encoding the functional RNA moiety is inserted or integrated at a native (naturally occurring) or artificial (engineered) restriction endonuclease cleavage site that is located in or adjacent to (typically within the 3' region of) the DNA encoding the Cas12a tracrRNA. In embodiments, the crRNA 3' extension includes nucleotides that when base-paired form about one helical turn, or at least 10 contiguous nucleotides. In embodiments, the Cas12a tracrRNA further includes a 5' extension. The functional RNA moiety is characterized by one or more functions. Embodiments of the RNA moiety include RNA sequences for annealing to one or more polynucleotides, RNA sequences that provide structures for binding to other molecules (including proteins or small molecule ligands) or that are catalytically active, or RNA sequences that serve as directly or indirectly detectable labels. In many embodiments of the method, the Cas12a crRNA is complexed with, or is capable of complexing with, a Cas12a nuclease to form a Cas12a ribonucleoprotein complex containing the functional RNA molecule; thus, in embodiments, the method further includes the step of associating or complexing a Cas12a nuclease with a Cas12a crRNA that has (e.g., in a preceding or simultaneous step), or will have (e.g., in a subsequent step) the functional RNA molecule tethered to it. In embodiments, the Cas12a nuclease is one having a naturally occurring sequence (e.g., a native sequence of a Cas12a nuclease such as, but not limited to, LbCas12a, AsCas12a, and FnCas12a); in other embodiments, the Cas12a nuclease includes a modification, such as an amino acid sequence modification or a chemical modification.

In a related aspect, the invention provides a modified Cas12a ribonucleoprotein complex including: (a) a Cas12a nuclease; (b) a functional RNA molecule including a Cas12a tracrRNA and a functional RNA moiety; and (c) a Cas12a crRNA that includes a 3' extension capable of hybridizing with a segment of the functional RNA molecule. In embodiments, the Cas12a nuclease is one having a naturally occurring sequence (e.g., a native sequence of a Cas12a nuclease such as, but not limited to, LbCas12a, AsCas12a, and FnCas12a); in other embodiments, the Cas12a nuclease includes a modification, such as an amino acid sequence modification or a chemical modification. In a preferred embodiment the expression and/or presence of the Cas12a tracrRNA enhances the genome editing capability of the Cas12a nuclease.

In another aspect, the invention provides a method of inserting a nucleotide sequence encoded by a donor polynucleotide at a specific locus in a target DNA, the method including: (a) annealing a donor polynucleotide to the modified Cas12a ribonucleoprotein complex of claim 12, wherein the functional RNA moiety includes an RNA sequence for annealing to the donor polynucleotide, and wherein the Cas12a crRNA includes a spacer sequence that corresponds to a specific target locus in a target DNA, thus forming a donor:RNP complex; and (b) contacting the target DNA with the donor:RNP complex; whereby the nucleotide sequence encoded by the donor polynucleotide is inserted at the specific target locus in the target DNA. In embodiments, the donor polynucleotide includes single-stranded DNA, optionally including chemical modifications. In embodiments, the donor polynucleotide includes double-stranded DNA, optionally including chemical modifications. In embodiments, the donor polynucleotide encodes coding sequence, non-coding sequence (e.g., a non-coding sequence or regulatory element that modifies expression of a target gene located at or near the target locus), or both coding and non-coding sequence. In embodiments, the target DNA is genomic DNA, e.g., genomic DNA or nuclear DNA of a eukaryote. In embodiments, the target DNA is mitochondrial or plastid DNA.

In another aspect, the invention provides a DNA expression system including (a) DNA sequence for a first promoter; and (b) operably linked and heterologous to the first promoter a DNA encoding a first RNA molecule including a Cas12a tracrRNA and including a restriction endonuclease cleavage site (native or engineered) that is suitable for insertion of a sequence coding for a functional RNA moiety. In embodiments, the DNA expression system further includes: (c) optionally, a DNA sequence for a second promoter; (d) operably linked and heterologous to the first promoter or the second promoter, a DNA encoding a Cas12a crRNA that includes a 3' extension capable of hybridizing with a segment of the first RNA molecule; and (e) optionally, a terminator; in embodiments, the first promoter and the DNA encoding the first RNA molecule, and the DNA encoding a Cas12a crRNA that includes a 3' extension are contained in a single construct, and in other embodiments, the first promoter and the DNA encoding the first RNA molecule are contained in a first construct, and the second promoter and the DNA encoding a Cas12a crRNA that includes a 3' extension are contained in a second construct. Where the DNA expression system is provided in a first construct and a second construct, these can be provided in a single vector or in separate vectors. In some embodiments wherein the DNA expression system includes DNA encoding a Cas12a crRNA, the first promoter drives expression of both the DNA encoding the first RNA molecule and the DNA encoding the Cas12a crRNA. In some embodiments, the Cas12a tracrRNA further includes a 5' extension. In many embodiments of the DNA expression system, the Cas12a crRNA is capable of complexing with a Cas12a nuclease to form a Cas12a ribonucleoprotein complex. In a preferred embodiment the expression and/or presence of the Cas12a tracrRNA enhances the genome editing capability of the Cas12a nuclease.

In another aspect, the invention provides a DNA expression system including: (a) DNA sequence for a first promoter; and (b) operably linked and heterologous to the first promoter, a DNA encoding a functional RNA molecule including a Cas12a tracrRNA and a functional RNA moiety. The functional RNA moiety is characterized by one or more functions. Embodiments of the RNA moiety include RNA sequences for annealing to one or more polynucleotides, RNA sequences that provide structures for binding to other molecules (including proteins or small molecule ligands) or that are catalytically active, or RNA sequences that serve as directly or indirectly detectable labels. In embodiments, the DNA expression system further includes: (c) optionally, a DNA sequence for a second promoter; (d) operably linked and heterologous to the first promoter or the second promoter, a DNA encoding a Cas12a crRNA that includes a 3' extension capable of hybridizing with a segment of the functional RNA molecule; and (e) optionally, a terminator. In embodiments wherein the DNA expression system includes the DNA encoding the Cas12a crRNA, the DNA expression system can be provided in a single construct (e.g., where the first promoter drives expression of both the DNA encoding the functional RNA molecule and the DNA encoding the Cas12a crRNA). In embodiments wherein the DNA expression system includes the second promoter, the second promoter can be operably linked to the DNA encoding the crRNA (e.g., in a second construct). In embodiments where the DNA expression system is provided in two constructs, these can be in a single vector or in separate vectors. In embodiments, the Cas12a tracrRNA further includes a 5' extension. In many embodiments of the DNA expression system, the Cas12a crRNA is capable of complexing with, a Cas12a nuclease to form a Cas12a ribonucleoprotein complex containing the functional RNA molecule. In embodiments, the Cas12a nuclease is one having a naturally occurring sequence (e.g., a native sequence of a Cas12a nuclease such as, but not limited to, LbCas12a, AsCas12a, and FnCas12a); in other embodiments, the Cas12a nuclease includes a modification, such as an amino acid sequence modification or a chemical modification. In a preferred embodiment the expression and/or presence of the Cas12a tracrRNA enhances the genome editing capability of the Cas12a nuclease.

In another aspect, the invention provides an engineered system including: (a) a Cas12a nuclease; and (b) at least one engineered Cas12a crRNA, or a polynucleotide encoding the engineered Cas12a crRNA, wherein the engineered Cas12a crRNA includes (i) at least one direct repeat sequence or fragment thereof that is capable of associating with the Cas12a nuclease, and (ii) a spacer sequence that is designed to hybridize with a target sequence in a eukaryotic cell, wherein the at least one direct repeat sequence or fragment thereof is adjacent to and 5' to the spacer sequence; and (c) a Cas12a tracrRNA including a nucleotide sequence that has at least 50% complementarity with, the nucleotide sequence of the at least one direct repeat of the engineered Cas12a crRNA. In another aspect, the invention further provides an engineered system including: (a) a Cas12a nuclease; and (b) at least one engineered Cas12a crRNA, or a polynucleotide encoding the engineered Cas12a crRNA, wherein the engineered Cas12a crRNA includes (i) at least one direct repeat sequence or fragment thereof that is capable of associating with the Cas12a nuclease, and (ii) a spacer sequence that is designed to hybridize with a target sequence in a eukaryotic cell, wherein the at least one direct repeat sequence or fragment thereof is adjacent to and 5' to the spacer sequence; and (c) a Cas12a tracrRNA including a naturally occurring putative Cas12a tracrRNA sequence that is identified from the same genomic region as the Cas12a nuclease by at least the following steps: (i) identifying in the genomic region flanking the DNA encoding the Cas12a nuclease at least one nucleotide sequence that includes a CRISPR array including direct repeats, and (ii) identifying as a putative Cas12a tracrRNA at least one nucleotide sequence in either the sense or antisense direction in the genomic region flanking the DNA encoding the Cas12a nuclease, wherein the putative Cas12a tracrRNA has a nucleotide sequence that has at least 50% complementarity with, the nucleotide sequence of the direct repeat. In yet another aspect, the invention provides an engineered system including: (a) one or more nucleotide sequences encoding a Cas12a nuclease; and (b) one or more nucleotide sequences encoding at least one engineered Cas12a crRNA that is designed to form a complex with the Cas12a nuclease and that includes a spacer sequence designed to hybridize with a target sequence in a eukaryotic cell; and (c) one or more nucleotide sequences encoding at least one Cas12a tracrRNA. In yet another aspect, the invention provides an engineered system including: (a) a Cas12a nuclease, or one or more nucleotide sequences encoding the Cas12a nuclease; and (b) at least one engineered Cas12a crRNA designed to form a complex with the Cas12a nuclease and including a spacer sequence designed to hybridize with a target sequence in a eukaryotic cell, or one or more nucleotide sequences encoding the at least one engineered Cas12a crRNA polynucleotide; and (c) at least one tracrRNA, or one or more nucleotide sequences encoding the at least one Cas12a tracrRNA. In embodiments of these engineered systems, the engineered Cas12a crRNA, or the polynucleotide (such as a pre-processed Cas12a crRNA precursor transcript) encoding the engineered Cas12a crRNA, further includes at least one direct repeat sequence or fragment thereof capable of associating with the Cas12a nuclease, wherein the at least one direct repeat sequence or fragment thereof is adjacent to and 3' to the spacer sequence. In embodiments of these engineered systems, the engineered Cas12a crRNA further includes a 3' extension adjacent to the spacer sequence. In embodiments of these engineered systems, the eukaryotic cell is a non-human animal cell (e.g., a cell of an animal selected from the group consisting of invertebrates, vertebrates, insects, arthropods, mollusks, fish, reptiles, amphibians, birds, mammals, primates, and non-human primates), a human cell, a plant cell, or a fungal cell. In embodiments of these engineered systems, the eukaryotic cell is in vitro, ex vivo, or in vivo.

In another aspect, the invention provides an engineered system including one or more vectors including: (a) a first regulatory element (such as a promoter) that is heterologous to and operably linked to one or more nucleotide sequences encoding a Cas12a nuclease; and (b) a second regulatory element (such as a promoter) that is heterologous to and operably linked to one or more nucleotide sequences encoding at least one engineered Cas12a crRNA that is designed to form a complex with the Cas12a nuclease and that includes a spacer sequence designed to hybridize with a target sequence in a eukaryotic cell; and (c) a third regulatory element (such as a promoter) that is heterologous to and operably linked to one or more nucleotide sequences encoding at least one Cas12a tracrRNA; wherein components (a) and (b) and (c) are located on the same vector or on different vectors of the system. In embodiments each of the regulatory elements includes one or more expression elements (such as a promoter, an enhancer, or an intron) that is functional in a eukaryotic cell.

In another aspect, the invention provides an engineered system including one or more vectors including: (a) a first expression cassette including at least a first promoter that is heterologous to and operably linked to one or more nucleotide sequences encoding a Cas12a nuclease and—optionally—a first transcription terminator sequence; and (b) a second expression cassette including at least a second promoter that is heterologous to operably linked to one or more nucleotide sequences encoding at least one engineered Cas12a crRNA that is designed to form a complex with the Cas12a nuclease and that includes a spacer sequence designed to hybridize with a target sequence in a eukaryotic cell and—optionally—a second transcription terminator sequence; and (c) a third expression cassette including at least a third promoter that is heterologous to operably linked to one or more nucleotide sequences encoding at least one Cas12a tracrRNA and—optionally—a third transcription terminator sequence, wherein components (a) and (b) and (c) are located on the same vector or on different vectors of the system. In embodiments each of the promoters and each of the transcription terminator sequences is functional in a eukaryotic cell. In embodiments, each of the promoters is heterologous to the nucleotide sequence of which the promoter drives expression.

Further aspects of the invention are related to the engineered systems disclosed and claimed herein. These aspects include compositions (e.g., a delivery particle or a delivery liquid) that include one or more of the engineered systems. Embodiments of the compositions include those wherein the Cas12a tracrRNA is present in a molar excess, relative to the amount of Cas12a nuclease. Specific embodiments of the compositions include those wherein the Cas12a tracrRNA is present in a molar amount that is at least 10-fold greater than the molar amount of the Cas12a nuclease. Additional aspects of the invention include a method of modifying a locus of interest having a target sequence of a eukaryotic cell including delivering one or more of the engineered systems to the locus of interest, wherein the spacer sequence hybridizes with the target sequence, whereby modification of the locus of interest occurs. In embodiments of the method, the locus of interest is within a eukaryotic cell. In embodiments of the method, the eukaryotic cell is a non-human animal cell (e.g., a cell of an animal selected from the group consisting of invertebrates, vertebrates, insects, arthropods, mollusks, fish, reptiles, amphibians, birds, mammals, primates, and non-human primates), a human cell, a plant cell, or a fungal cell. In embodiments of the method, the eukaryotic cell is in vitro, ex vivo, or in vivo. In embodiments of the method, the modification of the locus of interest is an insertion of at least one nucleotide, a deletion of at least one nucleotide, a change of at least one nucleotide (such as creation of a point mutation in the locus), non-homologous end-joining (NHEJ), or homology-dependent repair (HDR).

In another aspect, the invention provides a method of editing a genetic locus with a Cas12a nuclease, including contacting DNA that includes the genetic locus with: (a) a Cas12a nuclease; and (b) an engineered Cas12a crRNA that includes a spacer sequence that is designed to hybridize with a target sequence in the genetic locus; and (c) a Cas12a tracrRNA, thereby editing the genetic locus; wherein the efficiency of editing of the genetic locus is increased compared to a control method in which the DNA that includes the genetic locus is contacted with the Cas12a nuclease and the Cas12a crRNA, but not the Cas12a tracrRNA. In embodiments, the efficiency of editing is assessed by quantifying the amount of Cas12a nuclease required to obtain a given percentage of edited target sequences (or percentage of cells containing the edited target sequences); efficiency is increased where a given editing efficiency is achieved using a lower amount of Cas12a nuclease. In embodiments of the method, the Cas12a tracrRNA is provided in a molar excess, relative to the Cas12a nuclease. In embodiments of the method, the Cas12a tracrRNA is provided in a molar amount that is at least 10-fold greater than the molar amount of the Cas12a nuclease.

In a related aspect, the invention further provides a composition for modifying a genetic locus in a eukaryotic cell, including: (a) a eukaryotic cell containing a genetic locus to be modified; and (b) a Cas12a nuclease, or a polynucleotide encoding the Cas12a nuclease; and (c) an engineered Cas12a crRNA that includes a spacer sequence corresponding to a specific sequence in the genetic locus, or a polynucleotide encoding the Cas12a crRNA; and (d) a Cas12a tracrRNA, or a polynucleotide encoding the Cas12a tracrRNA, wherein the Cas12a tracrRNA is provided in molar excess relative to the Cas12a nuclease. In embodiments of the composition, the Cas12a tracrRNA is identified from the same genomic region as the Cas12a nuclease by at least the following steps: (a) identifying in the genomic region flanking the DNA encoding the Cas12a nuclease at least one nucleotide sequence that includes a CRISPR array including direct repeats; (b) identifying as a putative Cas12a tracrRNA at least one nucleotide sequence in either the sense or antisense direction in the genomic region flanking the DNA encoding the Cas12a nuclease, wherein the putative Cas12a tracrRNA has a nucleotide sequence that has at least 50% complementarity with, the nucleotide sequence of the direct repeat. In embodiments of the composition, the Cas12a tracrRNA is present in a molar excess, relative to the Cas12a nuclease. In embodiments of the composition, the Cas12a tracrRNA is present in a molar amount that is at least 10-fold greater than the molar amount of the Cas12a nuclease.

The DNA expression systems, engineered systems, compositions, and methods disclosed herein can be employed with Cas12a nucleases or modified variants thereof. In embodiments, the Cas12a nuclease is any one of the Cas12a ("Cpf1") nucleases disclosed in U.S. Pat. No. 9,790,490 or in U.S. patent application Ser. No. 15/566,528 (national phase entry of International Application No. PCT/EP2016/058442, published as WO2016166340), or in U.S. Pat. No. 9,896,696 which are specifically incorporated herein by reference. In embodiments, the Cas12a nuclease is a Cas12a ("Cpf1") nuclease identified from *Francisella novicida* U112 (FnCas12a or "FnCpf1"), from *Acidaminococcus* sp. BV3L6 (AsCas12a or "AsCpf1"), or from *Lachnospiraceae bacterium* ND2006 (LbCas12a or "LbCpf1"), or is an orthologue thereof, such as an orthologue having at least 50% sequence identity to FnCas12a ("FnCpf1"); see, e.g., the FnCpf1 nuclease contained in the FnCpf1 locus having SEQ ID NO:211 in U.S. Pat. No. 9,790,490, incorporated herein by reference. In embodiments, a Cas12a nuclease is (a) a Cas12a nuclease identified from the genome of a bacterial species selected from the group consisting of *Francisella tularensis* 1, *Prevotella albensis, Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, Smithella sp. SCADC, *Acidaminococcus* sp. BV3L6, *Lachnospiraceae bacterium* MA2020, *Candidatus* Methanoplasma *termitum, Eubacterium eligens, Moraxella* bovoculi 237, *Leptospira inadai, Lachnospiraceae bacterium* ND2006, *Porphyromonas* crevioricanis 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A. In embodiments, the Cas12a nuclease includes orthologues of LbCas12a, AsCas12a, or FnCas12a. In embodiments, the Cas12a nuclease is a deactivated Cas12a nuclease, a tagged or labelled Cas12a nuclease, or a Cas12a fusion; examples are described elsewhere in this disclosure. The systems and compositions including a tracrRNA and methods of use thereof that are disclosed herein can also be employed with related Cas nucleases, including Csm nucleases, e.g., ObCsm1 (GenBank accession number OGX23684), SmCsm1 (GenBank accession number KF067988), MiCsm1 (GenBank accession number KKQ38176), or SuCsm1 (GenBank accession number KIM12007) (see, e.g., Begemann et al. (2017) bioRxiv, publicly available at dx[dot]doi[dot]org/10[dot]1101/192799), nucleases having a sequence selected from the group consisting of SEQ ID NOs:115, 137, 138, and variants thereof, such as a variant ObCsm1 that differs from a wild-type ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

Related aspects of the invention include eukaryotes and eukaryotic cells containing a genomic modification obtained by use of the polynucleotides, compositions, engineered systems, and methods of use thereof disclosed herein. Embodiments include non-human animals and non-human animal cells, non-human animal stem cells, human cells, human stem cells, and human somatic (non-gametic) cells; isolated tissue (e.g., nervous tissue, epithelial tissue, liver, spleen, pancreas, muscle tissue, bone, connective tissue, endocrine system tissues, and tumours) or cells (e.g., blood cells, erythrocytes, leukocytes, lymphocytes, liver cells, bone cells, immune cells, T cells, B cells, dendritic cells, and tumour cells) or cell organelles (e.g., mitochondria or chloroplasts, either isolated or contained within the eukaryotic cell, tissue, or organism) obtained from a non-human animal or from a human; engineered hybridoma cells; fungi, fungal cells, plants, plant tissue, plant cells, and seeds having such a genomic modification, e.g., a genomic modification including a heterologous nucleotide sequence encoded by a donor polynucleotide and integrated into a specific locus in the genome, wherein the donor polynucleotide is provided in a donor:RNP complex that includes the donor polynucleotide ("donor") annealed to a modified Cas12a ribonucleoprotein ("RNP") that includes: (a) a Cas12a nuclease; (b) a functional RNA molecule including a Cas12a tracrRNA and a functional RNA moiety, wherein the functional RNA moiety includes an RNA sequence for annealing to the donor polynucleotide and optionally an RNA sequence for annealing to the crRNA 3' extension; and (c) a Cas12a crRNA that includes a 3' extension capable of hybridizing with a segment of the functional RNA molecule. Additional aspects of the invention include progeny plants or progeny seeds obtained from a plant, plant cell, plant tissue, or seed having a genomic modification obtained by use of the polynucleotides, compositions, and methods of use disclosed herein.

Also encompassed by the invention are raw plant materials, processed plant products, and commodity plant products obtained from a plant, plant cell, plant tissue, or seed (or from progeny plants or seeds thereof) having a genomic modification obtained by use of the polynucleotides, compositions, and methods of use disclosed herein.

BRIEF DESCRIPTION OF THE DRAWINGS

FIG. 3 illustrates the alignments of the reverse complement of the LbCpf1 direct repeat (DR) sequence, ATCTACACTTAGTAGAAATTATTTAATCTTTGAAAC (SEQ ID NO:5), with the LbCpf1 tracrRNA 1 ("putative tracrRNA 1") (SEQ ID NO:2) (top, showing 52.8% identity between the two sequences) and the LbCpf1 tracrRNA 2 ("putative tracrRNA 2") (SEQ ID NO:4) (bottom, showing 50.0% identity between the two sequences), as described in detail in Example 1.

FIG. 6 illustrates the alignment of the reverse complement of the AsCpf1 direct repeat (DR) sequence, ATCTACAAGAGTAGAAATTAAAAAGGTCTTTTGAC (SEQ ID NO:8) with the AsCpf1 tracrRNA ("putative tracrRNA") (SEQ ID NO:7), showing 51.4% identity between the two sequences as described in detail in Example 1.

FIG. 9B (right) schematically depicts an alternative design wherein the DNA expression system includes (a) DNA sequence for a first promoter; (b) operably linked and heterologous to the first promoter, a DNA encoding a first RNA molecule including a Cas12a tracrRNA or putative tracrRNA and including a restriction endonuclease cleavage site that is suitable for insertion of a sequence coding for a functional RNA moiety; and (c) operably linked and heterologous to the first promoter, a DNA encoding a Cas12a crRNA including multiple guide RNAs (Cas12a crRNAs), and including a 3' extension capable of hybridizing with a segment of the first RNA molecule, as described in detail in Example 3.

FIG. 9C (right) further schematically depicts an expression construct for expressing a guide RNA (Cas12a crRNA), as described in detail in Example 3.

FIG. 10 (bottom) schematically depicts a second DNA expression system, described in detail in Example 3, and similar to that shown in FIG. 10 (top), except that the guide RNA includes multiple guide RNAs, and includes a 3' extension capable of hybridizing with a segment of the first RNA molecule; the 3'-most direct repeat is optional.

FIG. 11 (top) schematically depicts construction of the DNA encoding the functional RNA molecule by cleavage at an HphI restriction endonuclease cleavage site ("cut site") in or adjacent to a Lb Cas12a tracrRNA ("P-tracr") and before the LbCas12a crRNA with a 3' extension ("E-crRNA"), insertion of DNA encoding multiple copies of an MS2 aptamer ("(n)×MS2") as well as sequence for annealing ("rcEX") to the crRNA 3' extension ("EX"), and ligation to form the DNA encoding the functional RNA molecule, which can be complexed with the Cas12a nuclease to form the ribonucleoprotein depicted in FIG. 11 (bottom).

DETAILED DESCRIPTION OF THE INVENTION

Figure 1:
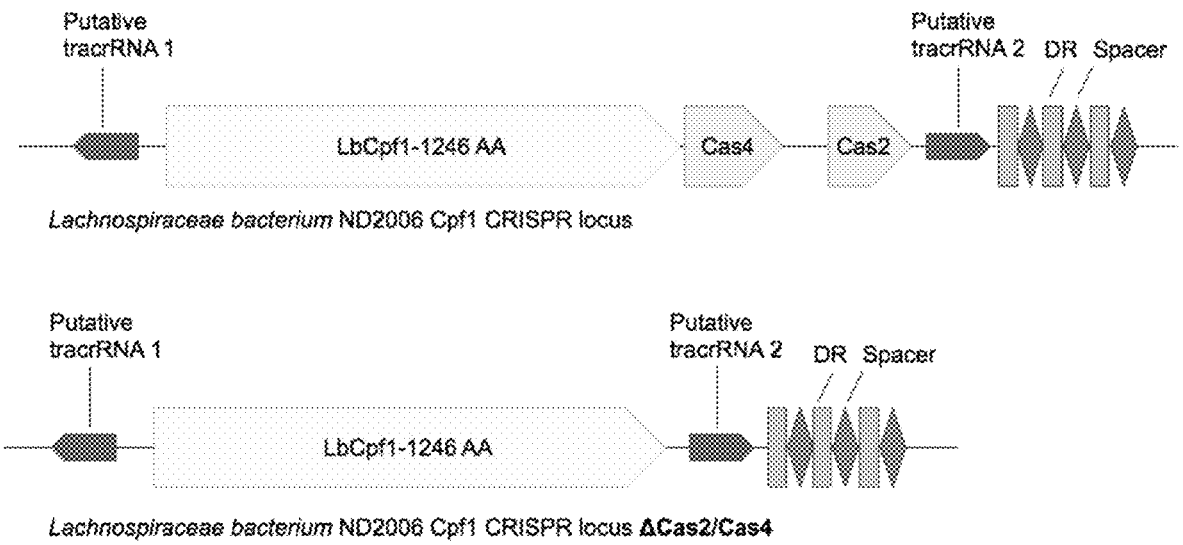
FIG. 1 illustrates schematics of the *Lachnospiraceae bacterium* ND2006 Cas12a ("LbCpf1") CRISPR locus and Cas12a tracrRNA ("putative tracrRNA") location as described in detail in Example 1. The schematics are shown with (upper figure) and without (lower figure) the Cas4 and Cas2 components of the locus. The direct repeats ("DR") are indicated by upright rectangles and the spacer sequences indicated by diamonds.

Unless otherwise stated, nucleic acid sequences in the text of this specification are given, when read from left to right, in the 5' to 3' direction. Nucleic acid sequences may be provided as DNA or as RNA, as specified; disclosure of one necessarily defines the other, as well as necessarily defines the exact complements, as is known to one of ordinary skill in the art. Where a term is provided in the singular, the inventors also contemplate aspects of the invention described by the plural of that term. As used herein, the terms "comprise," "comprises," "comprising," "include," "includes," and "including" can be interchanged and are to be construed as at least having the features to which they refer while not excluding any additional unspecified features. The term "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following embodiments: A, B, and C; A, B, or C; A or C; A or B; B or C; A and C; A and B; B and C; A (alone); B (alone); and C (alone).

By "polynucleotide" is meant a nucleic acid molecule containing multiple nucleotides and refers to "oligonucleotides" (defined here as a polynucleotide molecule of between 2-25 nucleotides in length) and polynucleotides of 26 or more nucleotides. Polynucleotides are generally described as single- or double-stranded. Where a polynucleotide contains double-stranded regions formed by intra- or intermolecular hybridization, the length of each double-stranded region is conveniently described in terms of the number of base pairs. Aspects of this invention include the use of polynucleotides or compositions containing polynucleotides; embodiments include one or more oligonucleotides or polynucleotides or a mixture of both, including single- or double-stranded RNA or single- or double-stranded DNA or double-stranded DNA/RNA hybrids or chemically modified analogues or a mixture thereof. In various embodiments, a polynucleotide includes a combination of ribonucleotides and deoxyribonucleotides (e.g., synthetic polynucleotides consisting mainly of ribonucleotides but with one or more terminal deoxyribonucleotides or synthetic polynucleotides consisting mainly of deoxyribonucleotides but with one or more terminal dideoxyribonucleotides), or includes non-canonical nucleotides such as inosine, thiouridine, or pseudouridine. In embodiments, the polynucleotide includes chemically modified nucleotides (see, e.g., Verma and Eckstein (1998) Annu. Rev. Biochem., 67:99-134); for example, the naturally occurring phosphodiester backbone of an oligonucleotide or polynucleotide can be partially or completely modified with phosphorothioate, phosphorodithioate, or methylphosphonate internucleotide linkage modifications; modified nucleoside bases or modified sugars can be used in oligonucleotide or polynucleotide synthesis; and oligonucleotides or polynucleotides can be labelled with a fluorescent moiety (e.g., fluorescein or rhodamine or a fluorescence resonance energy transfer or FRET pair of chromophore labels) or other label (e.g., biotin or an isotope). Modified nucleic acids, particularly modified RNAs, are disclosed in U.S. Pat. No. 9,464,124, incorporated by reference in its entirety herein.

"CRISPR (Clustered Regularly Interspaced Short Palindromic Repeats)/Cas (CRISPR-associated) systems," or CRISPR systems, are adaptive defense systems originally discovered in bacteria and archaea. CRISPR systems use RNA-guided nucleases termed CRISPR-associated or "Cas" endonucleases (e.g., Cas9 or Cas12a ("Cpf1")) to cleave foreign DNA. In atypical CRISPR/Cas system, a Cas endonuclease is directed to a target nucleotide sequence (e.g., a site in the genome that is to be sequence-edited) by sequence-specific, non-coding "guide RNAs" that target single- or double-stranded DNA sequences. In microbial hosts, CRISPR loci encode both Cas endonucleases and "CRISPR arrays" of the non-coding RNA elements that determine the specificity of the CRISPR-mediated nucleic acid cleavage.

Two classes (1 and 2) of CRISPR systems have been identified across a wide range of bacterial hosts. The well characterized class 2 CRISPR systems use a single Cas endonuclease (rather than multiple Cas proteins). One class 2 CRISPR system includes a type II Cas endonuclease such as Cas9, a CRISPR RNA ("crRNA"), and a trans-activating crRNA ("tracrRNA"). A "trans-activating crRNA" or "tracrRNA" is a trans-encoded small RNA that is partially homologous to repeats within a CRISPR array. At least in the case of Cas9 type CRISPR systems, both a tracrRNA and a crRNA are required for the CRISPR array to be processed and for the nuclease to cleave the target DNA sequence. In contrast, Cas12a type CRISPR systems have been reported to function without a tracrRNA, with the Cas12a CRISPR arrays processed into mature crRNAs without the requirement of a tracrRNA; see Zetsche et al. (2015) *Cell*, 163: 759-771 and U.S. Pat. No. 9,790,490. The Cas9 crRNA contains a "spacer sequence", typically an RNA sequence of about 20 nucleotides (in various embodiments this is 20, 21, 22, 23, 24, 25, or up to about 30 contiguous nucleotides in length) that corresponds to (e.g., is identical or nearly identical to, or alternatively is complementary or nearly complementary to) a target DNA sequence of about equivalent length. The Cas9 crRNA also contains a region that binds to the Cas9 tracrRNA to form a partially double-stranded structure which is cleaved by RNase III, resulting in a crRNA:tracrRNA hybrid or duplex. The crRNA:tracrRNA hybrid then directs the Cas9 endonuclease to recognize and cleave the target DNA sequence; in some examples, a tracrRNA and crRNA (e.g., a crRNA including a spacer sequence) can be included in a chimeric nucleic acid referred to as a "single guide RNA" (sgRNA).

The Cas12a ("Cpf1") CRISPR system includes the type V endonuclease Cas12a (also known as "Cpf1"). Cas12a nucleases are characterized as having only a RuvC nuclease domain, in contrast to Cas9 nucleases which have both RuvC and HNH nuclease domains. Cas12a nucleases are generally smaller proteins than Cas9 nucleases, and can function with a smaller guide RNA (e.g., a crRNA having at least one spacer flanked by direct repeats), which are practical advantages in that the nuclease and guide RNAs are more economical to produce and potentially more easily delivered to a cell. Examples of Cas12a nucleases include AsCas12a or "AsCpf1" (from *Acidaminococcus* sp.) and LbCas12a or "LbCpf1" (from Lachnospiraceae bacteria). In contrast to Cas9 type CRISPR systems, Cas12a-associated ("Cpf1"-associated) CRISPR arrays have been reported to be processed into mature crRNAs without the requirement of a tracrRNA, i.e., the naturally occurring Cas12a (Cpf1) CRISPR system was reported to require only the Cas12a (Cpf1) nuclease and a Cas12a crRNA to cleave the target DNA sequence; see Zetsche et al. (2015) *Cell,* 163:759-771; U.S. Pat. No. 9,790,490.

The term "tracrRNA" sequence or analogous terms includes any polynucleotide sequence that has sufficient complementarity with a crRNA sequence to hybridize. Embodiments of tracrRNA sequences useful in the compositions, engineered systems, and methods provided by this disclosure include those described as a "putative transactivating crRNA" or "putative tracrRNA" in U.S. Pat. No. 9,490,490 (e.g., in FIGS. 46, 48-51, and 54 of U.S. Pat. No. 9,490,490, and SEQ IDS NO: 28, 31, 34, 40, 43, 44, 47, and 50 of U.S. Pat. No. 9,490,490) and its priority documents, all of which are incorporated by reference herein. Embodiments of methods of identifying orthologues of CRISPR-Cas system enzymes may involve identifying tracrRNA sequences in genomes of interest.

The term "Cas12a tracrRNA" as used herein means a naturally occurring Cas12a tracrRNA or an engineered derivative thereof. In a preferred embodiment, the term "Cas12a tracrRNA" refers to a naturally occurring Cas12a tracrRNA has a nucleotide sequence that includes or comprises: (a) a nucleotide sequence or region of about 60 to about 100 contiguous nucleotides that has more than 50% identity to the direct repeat (DR) or tracr mate sequence in the Cas12a crRNA, preferably also has (b) secondary structure, and preferably also has (c) a transcriptional terminator. In some embodiments, a naturally occurring Cas12a tracrRNA has a nucleotide sequence that includes or comprises: (a) a nucleotide sequence or region of about 60 to about 100 contiguous nucleotides that has more than 50% identity to the direct repeat (DR) or tracr mate sequence in the Cas12a crRNA, and preferably also has (b) secondary structure, but is not associated with a transcriptional terminator. In some embodiments, the Cas12a tracrRNA is physically associated with the corresponding Cas12a crRNA and/or with the corresponding Cas12a nuclease. In other embodiments, the Cas12a tracrRNA is not physically associated with the corresponding Cas12a crRNA and/or with the corresponding Cas12a nuclease.

A naturally occurring tracrRNA sequence can be identified from a genome as DNA sequence encoding a RNA molecule (a "putative tracrRNA") that is predicted to be or putatively transcribed (or that may be determined to be transcribed, e.g., by RNA analysis) from a CRISPR genomic region, specifically from a locus that flanks the DNA encoding the CRISPR nuclease and that includes a predicted transcriptional terminator in the direction of transcription; is about 60 to about 100 nucleotides in length, e.g., 60-80 nucleotides, 60-85 nucleotides, 60-90 nucleotides, or 65-95 nucleotides; and is not a direct repeat in the CRISPR array, but rather has a nucleotide sequence of sufficient complementarity with a crRNA sequence to hybridize, e.g., of at least 50% identity to or at least 50% complementarity to the direct repeat in a CRISPR array. Steps for identifying tracrRNA sequences have been described, e.g., in U.S. Pat. No. 9,790,490, incorporated here by reference: "Identification of tracr sequences may relate to the following steps: Search for the direct repeats or tracr mate sequences in a database to identify a CRISPR region comprising a CRISPR enzyme. Search for homologous sequences in the CRISPR region flanking the CRISPR enzyme in both the sense and antisense directions. Look for transcriptional terminators and secondary structures. Identify any sequence that is not a direct repeat or a tracr mate sequence but has more than 50% identity to the direct repeat or tracr mate sequence as a potential tracr sequence. Take the potential tracr sequence and analyze for transcriptional terminator sequences associated therewith." RNA sequencing can be used to further characterize such sequences identified as potential or putative tracrRNAs.

In embodiments, an engineered Cas12a tracrRNA is used in place of or as a substitute for a naturally occurring tracrRNA or putative tracrRNA identified from a genome. In embodiments, an engineered Cas12a tracrRNA is designed based on guidelines similar to those employed for identifying a naturally occurring tracrRNA or putative tracrRNA identified from a genome. In embodiments, an engineered Cas12a tracrRNA is designed to have a sequence of about 60 to about 100 ribonucleotides and to have at least 50% complementarity to the sequence of the direct repeat of the Cas12a crRNA with which the engineered Cas12a tracrRNA is meant to be used. Engineered Cas12a tracrRNAs can be expressed with any of the systems described in this disclosure, e.g., in an expression construct using any of the promoters, terminator, or other expression elements described herein.

The genomic DNA sequence targeted for editing or modification must generally be adjacent to a "protospacer adjacent motif" ("PAM") that is specific for a given Cas endonuclease; however, PAM sequences are short and relatively non-specific, appearing throughout a given genome. CRISPR endonucleases identified from various prokaryotic species have unique PAM sequence requirements; examples of PAM sequences include 5'-NGG (*Streptococcus pyogenes*), 5'-NNAGAA (*Streptococcus thermophilus* CRISPR1), 5'-NGGNG (*Streptococcus thermophilus* CRISPR3), 5'-NNGRRT or 5'-NNGRR (*Staphylococcus aureus* Cas9, SaCas9), and 5'-NNNGATT (*Neisseria meningitidis*). Some endonucleases, e.g., Cas9 endonucleases, are associated with G-rich PAM sites, e.g., 5'-NGG, and perform blunt-end cleaving of the target DNA at a location three nucleotides upstream from (5' from) the PAM site. Cas12a (Cpf1) CRISPR systems cleave the target DNA adjacent to a short T-rich PAM sequence, e.g., 5'-TTN, in contrast to the G-rich PAM sequences identified for Cas9 systems. Examples of Cas12a PAM sequences include those for the naturally occurring *Acidaminococcus* sp. BV3L6 Cpf1 (AsCpf1) and *Lachnospiraceae bacterium* ND2006 Cpf1 (LbCpf1) TTTV, where V can be A, C, or G. In some instances, Cas12a can also recognize a 5'-CTA PAM motif Other examples of potential Cas12a PAM sequences include TTN, CTN, TCN, CCN, TTTN, TCTN, TTCN, CTTN, ATTN, TCCN, TTGN, GTTN, CCCN, CCTN, TTAN, TCGN, CTCN, ACTN, GCTN, TCAN, GCCN, and CCGN (wherein N is defined as any nucleotide). Various methods (including in silico and/or wet lab methods) for identification of the appropriate PAM sequence are known in the art and are routine, and any convenient method can be used. A PAM sequence can be identified using a PAM depletion assay. Cas12a cleaves the target DNA by introducing an offset or staggered double-strand break with a 4- or 5-nucleotide 5' overhang, for example, cleaving a target DNA with a 5-nucleotide offset or staggered cut located 18 nucleotides downstream from (3' from) from the PAM site on the coding strand and 23 nucleotides downstream from the PAM site on the complimentary strand; the 5-nucleotide overhang that results from such offset cleavage allows more precise genome editing by DNA insertion by homologous recombination than by insertion at blunt-end cleaved DNA. See, e.g., Zetsche et al. (2015) *Cell,* 163:759-771.

For the purposes of gene editing, CRISPR arrays can be designed to contain one or multiple guide RNAs designed to target a DNA sequence for editing, where the guide RNA includes at least one spacer sequence that corresponds to a specific locus of about equivalent length in the target DNA; see, for example, Cong et al. (2013) *Science,* 339:819-823; Ran et al. (2013) *Nature Protocols,* 8:2281-2308. As used herein "guide RNA" or "gRNA" refers to a nucleic acid that comprises or includes a nucleotide sequence (sometimes referred to a "spacer sequence") that corresponds to (e.g., is identical or nearly identical to, or alternatively is complementary or nearly complementary to) a target DNA sequence (e.g., a contiguous nucleotide sequence that is to be modified) in a genome; the guide RNA functions in part to direct the CRISPR nuclease to a specific location on the genome. In embodiments, a gRNA is a CRISPR RNA ("crRNA"), such as the engineered Cas12a crRNAs described in this disclosure. For nucleases (such as a Cas9 nuclease) that require a combination of a trans-activating crRNA ("tracrRNA") and a crRNA for the nuclease to cleave the target nucleotide sequence, the gRNA can be a tracrRNA:crRNA hybrid or duplex, or can be provided as a single guide RNA (sgRNA). At least 16 or 17 nucleotides of gRNA sequence corresponding to a target DNA sequence are required by Cas9 for DNA cleavage to occur; for Cas12a (Cpf1) at least 16 nucleotides of gRNA sequence corresponding to a target DNA sequence are needed to achieve detectable DNA cleavage and at least 18 nucleotides of gRNA sequence corresponding to a target DNA sequence were reported necessary for efficient DNA cleavage in vitro; see Zetsche et al. (2015) *Cell,* 163:759-771. Cas12a (Cpf1) endonuclease and corresponding guide RNAs and PAM sites are disclosed in U.S. Pat. No. 9,790,490, which is incorporated herein by reference in its entirety and particularly for its disclosure of DNA encoding Cas12a (Cpf1) endonucleases and guide RNAs and PAM sites. In practice, guide RNA sequences are generally designed to contain a spacer sequence of between 17-24 contiguous nucleotides (frequently 19, 20, or 21 nucleotides) with exact complementarity (e.g., perfect base-pairing) to the targeted gene or nucleic acid sequence; guide RNAs having spacers with less than 100% complementarity to the target sequence can be used (e.g., a gRNA with a spacer having a length of 20 nucleotides and between 1-4 mismatches to the target sequence), but this can increase the potential for off-target effects. The design of effective guide RNAs for use in plant genome editing is disclosed in U.S. Patent Application Publication 2015/0082478 A1, the entire specification of which is incorporated herein by reference. Chemically modified sgRNAs have been demonstrated to be effective in Cas9 genome editing; see, for example, Hendel et al. (2015) *Nature Biotechnol.,* 33:985-991.

CRISPR-type genome editing has value in various aspects of agriculture research and development. CRISPR elements, e.g., CRISPR endonucleases and CRISPR single-guide RNAs, are useful in effecting genome editing without remnants of the CRISPR elements or selective genetic markers occurring in progeny. Alternatively, genome-inserted CRISPR elements are useful in plant lines adapted for multiplex genetic screening and breeding. For instance, a plant species can be created to express one or more of a CRISPR endonuclease such as a Cas12a-type endonuclease or combinations with unique PAM recognition sites. Introduction of one or more of a wide variety of CRISPR guide RNAs that interact with CRISPR endonucleases integrated into a plant genome or otherwise provided to a plant is useful for genetic editing for providing desired phenotypes or traits, for trait screening, or for trait introgression. Multiple endonucleases can be provided in expression cassettes with the appropriate promoters to allow multiple genome editing in a spatially or temporally separated fashion in either in chromosome DNA or episome DNA.

CRISPR technology for editing the genes of eukaryotes is disclosed in U.S. Patent Application Publications 2016/0138008A1 and US2015/0344912A1, and in U.S. Pat. Nos. 8,697,359, 8,771,945, 8,945,839, 8,999,641, 8,993,233, 8,895,308, 8,865,406, 8,889,418, 8,871,445, 8,889,356, 8,932,814, 8,795,965, and 8,906,616. Cas12a (Cpf1) endonuclease and corresponding guide RNAs and PAM sites are disclosed in U.S. Pat. No. 9,790,490 and U.S. patent application Ser. No. 15/566,528 (national phase of PCT Application PCT/EP2016/058442, published as WO 2016/166340). Plant RNA promoters for expressing CRISPR guide RNA and plant codon-optimized CRISPR Cas9 endonuclease are disclosed in U.S. patent application Ser. No. 15/120,110, published as U.S. Patent Application Publication 2017/0166912, national phase application claiming priority to International Patent Application PCT/US2015/018104 (published as WO 2015/131101 and claiming priority to U.S. Provisional Patent Application 61/945,700). Methods of using CRISPR technology for genome editing in plants are disclosed in in U.S. Patent Application Publications U.S. 2015/0082478A1 and U.S. 2015/0059010A1 and in International Patent Application PCT/US2015/038767 A1 (published as WO 2016/007347 and claiming priority to U.S. Provisional Patent Application 62/023,246). All of the patent publications referenced in this paragraph are incorporated herein by reference in their entirety.

Endonucleases such as Cas9 and Cas12a (Cpf1) can be provided to a cell in different forms. In an embodiment, an endonuclease is provided as a ribonucleoprotein (RNP) complex, e.g., a preassembled RNP that includes the endonuclease complexed with a polynucleotide including the gRNA or encoding a gRNA, or a preassembled RNP that includes a polynucleotide that encodes the endonuclease (and optionally encodes the gRNA, or is provided with a separate polynucleotide including the gRNA or encoding a gRNA), complexed with a protein. In embodiments, the endonuclease is a fusion protein, i.e., wherein the endonuclease is covalently bound through a peptide bond to a cell-penetrating peptide, a nuclear localization signal peptide, a chloroplast transit peptide, or a mitochondrial targeting peptide; such fusion proteins are conveniently encoded in a single nucleotide sequence, optionally including codons for linking amino acids. In embodiments, the endonuclease or a polynucleotide that encodes the endonuclease is provided as a complex with a cell-penetrating peptide or other transfecting agent. In embodiments, the endonuclease or a polynucleotide that encodes the endonuclease is complexed with, or covalently or non-covalently bound to, a further element, e.g., a carrier molecule, an antibody, an antigen, a viral movement protein, a polymer, a detectable label (e.g., a moiety detectable by fluorescence, radioactivity, or enzymatic or immunochemical reaction), a quantum dot, or a particulate or nanoparticulate. In embodiments, the endonuclease or a polynucleotide that encodes the endonuclease is provided in a solution, or is provided in a liposome, micelle, emulsion, reverse emulsion, suspension, or other mixed-phase composition. Similarly, editing complexes such as those disclosed herein (or compositions including such editing complexes) can be provided in combination with further elements (e.g., a carrier molecule, an antibody, an antigen, a viral movement protein, a polymer, a detectable label, a quantum dot, or a particulate or nanoparticulate) or provided in a suitable form (e.g., in a solution, liposome, micelle, emulsion, reverse emulsion, suspension, or other mixed-phase composition).

By "integration of heterologous sequence" is meant integration or insertion of one or more nucleotides, resulting in a sequence (including the inserted nucleotide(s) as well as at least some adjacent nucleotides of the genomic sequence flanking the site of insertion at a double-strand break effected by a CRISPR endonuclease) that is heterologous (e.g., would not otherwise or does not normally occur at the site of insertion). The term "heterologous" is also used to refer to a given sequence in relationship to another, e.g., the sequence of a donor DNA is heterologous to the sequence at the site of the double-strand break wherein the donor DNA is integrated. The term "heterologous" is also used to refer to components of a synthetic polynucleotide construct, where the components do not naturally occur together; for example, an expression cassette or construct can include a promoter to drive expression of a downstream sequence, where the promoter is heterologous to that downstream sequence. As used herein, the terms "heterologous promoter", "heterologous terminator", "heterologous coding sequence", and the like refer to discrete genetic sequences such as promoters and other expression-related genetic elements (e.g., promoters, enhancers, introns, terminators, silencers, and insulators), that are not normally associated with a particular nucleic acid in nature. For example, a "promoter that is heterologous to a coding region" is a promoter that is not normally associated with the coding region in nature.

By "capable of specifically binding to" is meant an agent that binds substantially or preferentially only to a defined target (such as an oligonucleotide or polynucleotide to a specific nucleic acid). In some examples, an oligonucleotide or polynucleotide capable of specifically binding to a target nucleic acid is complementary to the target nucleic acid. However, exact complementarity is not required for specific binding. The term "capable of hybridizing" refers to the ability of two polynucleotides to hybridize or "anneal", i.e., to form Watson-Crick base pairs; one of skill in the art would understand that the ability to hybridize requires a sufficient degree of complementarity between the two polynucleotides under given conditions (e.g., temperature) and that the degree of complementarity can be estimated using algorithms in the art.

By "complementary" is meant sequences with at least sufficient complementarity to permit enough base-paring for two nucleic acids to hybridize (for example, for a tether to hybridize with or bind to a gRNA or donor DNA), which in some examples may be under typical physiological conditions for the cell. In some examples, the oligonucleotide or polynucleotide is at least 80% complementary to the target, for example, at least 85%, 90%, 95%, 96%, 97%, 98%, 99%, or 100% complementary to the target.

A polynucleotide or polypeptide has a certain percent "sequence identity" to another polynucleotide or polypeptide, meaning that, when aligned, that percentage of bases or amino acids are the same, and in the same relative position, when comparing the two sequences. Sequence similarity can be determined in a number of different manners. To determine sequence identity, sequences can be aligned using the methods and computer programs, including BLAST, available at ncbi[dot]nlm[dot]nih[dot]gov/BLAST. See, e.g., Altschul et al. (1990) *Mol. Biol.*, 215:403-410. Another alignment algorithm is FASTA, available in the Genetics Computing Group (GCG) package, from Madison, Wisconsin, USA, a wholly owned subsidiary of Oxford Molecular Group, Inc. Other techniques for alignment are described in Methods in Enzymology, vol. 266: Computer Methods for Macromolecular Sequence Analysis (1996), ed. Doolittle, Academic Press, Inc., a division of Harcourt Brace & Co., San Diego, California, USA. Of particular interest are alignment programs that permit gaps in the sequence. The Smith-Waterman is one type of algorithm that permits gaps in sequence alignments. See *Meth. Mol. Biol.*, 70: 173-187 (1997). Also, the GAP program using the Needleman and Wunsch alignment method can be utilized to align sequences. See *Mol. Biol.*, 48: 443-453 (1970).

The term "operably linked" refers to a juxtaposition wherein the components so described are in a relationship permitting them to function in their intended manner. For instance, a promoter is operably linked to a coding sequence if the promoter affects its transcription or expression.

By "native" is meant naturally occurring in a genome, such as a prokaryotic or eukaryotic genome. A "native" restriction endonuclease cleavage site means a restriction endonuclease cleavage site that is found in a naturally existing genome, such as a restriction endonuclease cleavage site that is naturally found within genomic DNA encoding the tracrRNA, in contrast to an artificial or engineered restriction endonuclease cleavage site that is created through recombinant nucleic acid technology.

By "engineered" is meant artificial, synthetic, or not occurring in nature. For example, a polynucleotide that includes two DNA sequences that are heterologous to each other can be engineered or synthesized by recombinant nucleic acid techniques.

By a "complex" is meant two or more associated components, such as two or more associated nucleic acids and/or proteins. A complex may include two or more covalently linked nucleic acids and/or proteins, two or more non-covalently linked nucleic acids and/or proteins, or a combination thereof. In an example, a complex includes a nuclease (such as a Cas12a nuclease) and an appropriate crRNA; such a complex can optionally include one or more polynucleotides, such as the tracrRNA molecules described herein, donor polynucleotides, and functional RNA moieties. In some examples, a complex includes a gRNA (such as a crRNA) and a donor polynucleotide (or a template for production of a donor polynucleotide), which may be covalently or non-covalently linked. In other examples, a complex includes a nuclease and a donor DNA, which may be covalently linked. In further example, a complex includes one or more CRISPR nuclease polypeptides, a gRNA, and a donor DNA (or a template for production of donor DNA).

By "covalently linked" is meant that two elements (such as a gRNA and a tether or a gRNA and a donor DNA) are joined by a covalent bond, for example, an internucleotide linkage such as a phosphodiester bond, a phosphorothioate bond, a phosphothioate bond, or a peptide bond.

By "non-covalently linked" is meant that two elements (such as two discrete polynucleotides, or a polypeptide and a polynucleotide) interact non-covalently, for example by hydrogen bonding, such as Watson-Crick base pairing. Other non-covalent interactions include non-Watson-Crick pairing, electrostatic interactions, van der Waals forces, 71-effects, and hydrophobic effects.

By "in vivo" is meant that the systems, compositions, and methods of this disclosure are applied to or within a living organism, such as a living intact non-human animal, a living human, or a living plant or seed. By "in vitro" is meant that the systems, compositions, and methods of this disclosure are applied to cells or tissue maintained alive independently of an intact multicellular organism, such as a living intact non-human animal, a living intact human, or a living intact plant or seed; examples of in vitro embodiments include those where the systems, compositions, and methods of this disclosure are applied to stable or transient animal or plant cell lines in culture and tissue samples in culture. In vitro embodiments further include prokaryotic cell cultures. By "ex vivo" is meant occurring in cells, tissue, or organs (e.g., blood, blood cells, T cells, liver cells or tissue, skin, bone, muscle, eggs or ovules, sperm, pollen, etc.) removed from a living non-human animal, human, or plant and at least temporarily maintained alive in culture. Ex vivo cells or tissues may be returned to a living intact multicellular organism, such as the living non-human animal, human, or plant from which the cells or tissue were originally removed. In an embodiment, the systems, compositions, and methods of this disclosure are applied to human T-cells for the purpose of generating chimeric antigen receptor T cells ("CAR-T cells"), which may be delivered to a human as a therapeutic; see, e.g., Liu et al., *Frontiers Immunol.*, 10:456, available at doi: 10.3389/fimmu.2019.00456. Ex vivo cells or tissues may be grown into differentiated tissue or even differentiated organs, or undifferentiated tissue or callus. Ex vivo plant cells or plant tissues may be grown into intact plants.

Method of Tethering a Functional RNA Molecule to a Cas12a crRNA or a Cas12a Ribonucleoprotein An aspect of this invention provides a method of tethering a functional RNA molecule to a Cas12a crRNA, optionally to a Cas12a ribonucleoprotein including a Cas12a nuclease and a Cas12a crRNA. In embodiments, the method includes the step of hybridizing (a) a functional RNA molecule including a Cas12a tracrRNA and a functional RNA moiety; and (b) a Cas12a crRNA that includes a 3' extension capable of hybridizing with a segment of the functional RNA molecule; thereby tethering the functional RNA molecule to the Cas12a crRNA. In embodiments, the method includes the step of hybridizing (a) a functional RNA molecule including a Cas12a tracrRNA and a functional RNA moiety; and (b) a naturally occurring Cas12a crRNA that optionally includes a 3' extension capable of hybridizing with a segment of the functional RNA molecule; thereby tethering the functional RNA molecule to the Cas12a crRNA. In embodiments, the method includes the step of hybridizing (a) a functional RNA molecule including a Cas12a tracrRNA and a functional RNA moiety; and (b) an engineered Cas12a crRNA that optionally includes a 3' extension capable of hybridizing with a segment of the functional RNA molecule; thereby tethering the functional RNA molecule to the Cas12a crRNA.

Embodiments of a "Cas12a tracrRNA" include an RNA molecule having the nucleotide sequence of a naturally occurring tracrRNA identified from a native Cas12a locus. For example, a naturally occurring Cas12a tracrRNA can be identified from a genome using the techniques described by Zetsche et al. (2015) *Cell*, 163:759-771, and in U.S. Pat. No. 9,790,490. A naturally occurring Cas12a tracrRNA can be identified from a genome as DNA sequence encoding a RNA molecule that: is predicted to be or putatively transcribed (or that may be determined to be transcribed, e.g., by RNA analysis) from a Cas12a CRISPR genomic region, specifically from a locus that flanks the DNA encoding the Cas12a CRISPR nuclease; that preferably but not necessarily includes a predicted transcriptional terminator in the direction of transcription; that is about 60 to about 100 nucleotides in length, e.g., 60-80 nucleotides, 60-85 nucleotides, 60-90 nucleotides, or 65-95 nucleotides; and that is not a direct repeat in the Cas12a CRISPR array, but rather has a nucleotide sequence that permits the transcribed tracrRNA to hybridize to the crRNA (i.e., the transcribed tracrRNA has sufficient complementarity to a crRNA sequence to hybridize to the crRNA). In embodiments, the Cas12a tracrRNA locus is directly adjacent to the DNA encoding the Cas12a nuclease. In embodiments, there is additional genomic sequence, such as DNA sequence encoding other Cas nucleases, located between the Cas12a tracrRNA locus and the DNA encoding the Cas12a nuclease; see, e.g., FIGS. 1 and 4. In embodiments, the transcribed tracrRNA has a nucleotide sequence having at least 50% identity (e.g., at least 50%, at least 51%, at least 52%, at least 53%, at least 54%, at least 55%, at least 56%, at least 57%, at least 58%, at least 59%, or at least 60% sequence identity) to the sequence of the direct repeat. In embodiments, the Cas12a tracrRNA has a sequence that is selected from the group consisting of SEQ ID NOs:1, 3, 6, 139-146, 149-169, 223-240, and 241. An alternative embodiment of a "Cas12a tracrRNA" includes an RNA molecule having or including a nucleotide sequence based on the nucleotide sequence of a naturally occurring tracrRNA identified from a native Cas12a locus. Examples include RNA molecules that include the nucleotide sequence of a tracrRNA (or putative tracrRNA) identified from a native Cas12a locus but that further include one or more modifications such as (a) additional nucleotides, e.g., an extension at the 3' terminus, (b) insertion, deletion, or substitution of one or more nucleotides within the naturally occurring tracrRNA sequence, preferably maintaining the secondary structure of the tracrRNA, and (c) chemical modifications, e.g., addition of a detectable label.

In embodiments of the method, the functional RNA molecule is provided by transcription of a DNA molecule including DNA encoding the Cas12a tracrRNA and DNA encoding the functional RNA moiety, wherein the DNA encoding the functional RNA moiety is inserted at a restriction endonuclease cleavage site in or adjacent to the DNA encoding the Cas12a tracrRNA. In embodiments, the restriction endonuclease cleavage site is located within the 3' region of the DNA encoding the Cas12a tracrRNA, or within a short distance (e.g., within about 40, about 30, about 20, or about 10 nucleotides) of the 3' end of the Cas12a tracrRNA. In embodiments, the restriction endonuclease cleavage site occurs natively in the Cas12a tracrRNA, that is to say, occurs in a naturally occurring DNA sequence that encodes a predicted or putative Cas12a tracrRNA. In other embodiments, the restriction endonuclease cleavage site is artificial or engineered; a non-limiting example includes a naturally occurring DNA sequence that encodes a predicted or putative Cas12a tracrRNA and further includes at least one nucleotide that is artificially added, deleted, or substituted to provide an engineered restriction endonuclease cleavage site located in or adjacent to the sequence encoding the tracrRNA.

In embodiments of the method, the crRNA 3' extension includes nucleotides that when base-paired form about one helical turn. In embodiments, the crRNA 3' extension includes at least 10 contiguous nucleotides. In embodiments, the crRNA 3' extension improves hybridization of the Cas12a crRNA to the Cas12a tracrRNA. In some embodiments, the Cas12a tracrRNA further includes a 5' extension, such as the 5' extensions disclosed by Park et al. (2018) *Nature Communications*, doi: 10.1038/s41467-018-05641-3.

The functional RNA molecule includes a Cas12a tracrRNA and at least one functional RNA moiety. In embodiments, the functional RNA moiety is a nucleotide sequence inserted at a restriction endonuclease cleavage site in or adjacent to the DNA encoding the Cas12a tracrRNA. Non-limiting embodiments of functional RNA moieties include: (a) an RNA sequence for annealing to a donor polynucleotide (e.g., a single- or double-stranded DNA containing a nucleotide template for HDR-mediated editing, or a single- or double-stranded polynucleotide including a nucleotide sequence to be integrated by an NHEJ mechanism at a double-stranded break effected, for example, by the Cas12a nuclease); (b) an RNA sequence for annealing to the crRNA 3' extension; (c) a terminator sequence; (d) an RNA aptamer; (e) a ribozyme or catalytically active RNA; (f) a detectable label, such as a fluorescent tag; (g) a bar-coding sequence, or short nucleotide sequence useful for marking and identifying DNA that contains the bar-coding sequence; and (h) an RNA sequence forming at least partially double-stranded RNA. In an embodiment, the functional RNA moiety includes RNA forming at least partially double-stranded RNA capable of silencing a gene (e.g., RNA that forms one or more stem-loops where the stem includes double-stranded RNA of at least about 18 base-pairs designed to silence a target gene, or RNA that has the secondary structure of a microRNA precursor and is processed to a mature microRNA designed to silence a target gene). In embodiments, the functional RNA moiety is a terminator, e.g., a terminator functional in eukaryotic cells, such as a U6 poly-T terminator, an SV40 terminator, an hGH terminator, a BGH terminator, an rbGlob terminator, a synthetic terminator functional in a eukaryotic cell, a 3' element from an *Agrobacterium* sp. gene, a 3' element from a non-human animal gene, a 3' element from a human gene, and a 3' element from a plant gene, wherein the 3' element terminate transcription of an RNA transcript located immediately 5' to the 3' element. Non-limiting examples of RNA aptamers include an MS2 aptamer (see Parrott et al. (2000) *Nucleic Acids Res.*, 28(2):489-497), an ARiBo tag (see Di Tomasso et al. (2011) *Nucleic Acids Res.*, 39(3):e18; doi: 10.1093/nar/gkq1084), a streptavidin-binding aptamer (see Leppek and Stoecklin (2014) *Nucleic Acids Res.*, 452(2): e13; doi: 10.1093/nar/gkt956), a Csy4 aptamer (see Lee et al. (2013) *Proc. Natl. Acad. Sci. USA*, 110(14):5416-5421; doi: 10.1073/pnas.1302807110, and a Sephadex aptamer (see Srisawat and Engelke (2002) *Methods*, 26(2):156-161; doi: 10.1016/S1046-2023(02)00018-X. Many aptamers are useful for affinity purification and tagging; for example, a two-element affinity tag useful for preparing large quantities of RNA includes a variant of the hepatitis delta virus (H6V) ribozyme that is activated by imidazole and a hairpin loop from a thermostable SRP RNA that forms a high-affinity and kinetically stable complex with the *Thermotoga maritima* Ffh-M domain protein (see Keift and Batey (2004) *RNA*, 10(6): 988-995; doi: 10.1261/rna.7040604).

In embodiments, the method includes the step of hybridizing in vitro (a) a functional RNA molecule including a Cas12a tracrRNA and a functional RNA moiety; and (b) a Cas12a crRNA that includes a 3' extension capable of hybridizing with a segment of the functional RNA molecule. In embodiments, the method includes the step of hybridizing in vitro (a) a functional RNA molecule including a Cas12a tracrRNA and a functional RNA moiety; and (b) a naturally occurring or an engineered Cas12a crRNA that optionally includes a 3' extension capable of hybridizing with a segment of the functional RNA molecule. In some embodiments, a heating (melting) step and a cooling step are employed during the hybridization. In some embodiments, the hybridization is carried out at room temperature, without additional heating or cooling steps.

In many embodiments of the method, the Cas12a crRNA is complexed with, or is capable of complexing with, a Cas12a nuclease to form a Cas12a ribonucleoprotein complex containing the functional RNA molecule. Complexing of the Cas12a crRNA with the Cas12a nuclease can occur prior to, concurrently with, or after hybridization of the functional RNA molecule with the Cas12a crRNA. In embodiments, the method includes the step of hybridizing (a) a functional RNA molecule including a Cas12a tracrRNA and a functional RNA moiety; and (b) a naturally occurring Cas12a crRNA that optionally includes a 3' extension capable of hybridizing with a segment of the functional RNA molecule; following this hybridization, the Cas12a nuclease is added to form the Cas12a ribonucleoprotein. In embodiments, the method includes the step of hybridizing (a) a functional RNA molecule including a Cas12a tracrRNA and a functional RNA moiety; and (b) an engineered Cas12a crRNA that optionally includes a 3' extension capable of hybridizing with a segment of the functional RNA molecule; following this hybridization, the Cas12a nuclease is added to form the Cas12a ribonucleoprotein. A related aspect of the invention is therefore a modified Cas12a ribonucleoprotein complex including (a) a Cas12a nuclease; (b) a functional RNA molecule including a Cas12a tracrRNA and a functional RNA moiety; and (c) a naturally occurring or an engineered Cas12a crRNA that optionally includes a 3' extension capable of hybridizing with a segment of the functional RNA molecule.

In embodiments of the method wherein the Cas12a crRNA is complexed with, or is capable of complexing with, a Cas12a nuclease, or in embodiments of the modified Cas12a ribonucleoprotein complex thus formed, the Cas12a nuclease is any one of the Cas12a ("Cpf1") nucleases disclosed in U.S. Pat. No. 9,790,490 or in U.S. patent application Ser. No. 15/566,528 (national phase entry of International Application No. PCT/EP2016/058442, published as WO2016166340), or in U.S. Pat. No. 9,896,696 which are specifically incorporated herein by reference. In specific embodiments, the Cas12a nuclease is a Cas12a ("Cpf1") nuclease identified from *Francisella novicida* U112 (FnCas12a or "FnCpf1"), from *Acidaminococcus* sp. BV3L6 (AsCas12a or "AsCpf1"), or from *Lachnospiraceae bacterium* ND2006 (LbCas12a or "LbCpf1"), or is an orthologue thereof, such as an orthologue having at least 50% sequence identity to FnCas12a ("FnCpf1"); see, e.g., the FnCpf1 nuclease contained in the FnCpf1 locus having SEQ ID NO:211 in U.S. Pat. No. 9,790,490, incorporated herein by reference. In embodiments, a Cas12a nuclease is (a) a Cas12a nuclease identified from the genome of a bacterial species selected from the group consisting of *Francisella tularensis* 1, *Prevotella albensis, Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, Smithella sp. SCADC, *Acidaminococcus* sp. BV3L6, *Lachnospiraceae bacterium* MA2020, *Candidatus Methanoplasma termitum, Eubacterium eligens, Moraxella bovoculi* 237, *Leptospira inadai, Lachnospiraceae bacterium* ND2006, *Porphyromonas crevioricanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of 1339P, L342F, Q588K, F1017Q, K1047E, N1118D, F1128Y, L867I, D917A, E1006A, and D1255A. In embodiments, the Cas12a nuclease includes orthologues of LbCas12a, AsCas12a, or FnCas12a. In embodiments, the Cas12a nuclease is deactivated. In embodiments, the Cas12a nuclease includes at least one modification selected from the group consisting of: (a) a localization or signal peptide (e.g., a nuclear localization signal (NLS), a chloroplast or plastid transit peptide (CTP), or a mitochondrial targeting peptide (MTP)); (b) a detectable label (e.g., a fluorescent dye); (c) a cell-penetrating peptide; (d) an endosomal escape peptide; and (e) an affinity tag. In embodiments, the Cas12a nuclease includes at least one modification selected from a fluorescent protein (e.g., green fluorescent protein (GFP), YFP, RFP, CFP, mCherry, tdTomato, mScarlett), a histidine tag (e.g., a 6XHis tag), a hemagglutinin (HA) tag, a FLAG tag, a Myc tag, horseradish peroxidase (HRP), alkaline phosphatase (AP), beta-galactosidase (GAL), glucose-6-phosphate dehydrogenase, beta-N-acetylglucosaminidase, beta-glucuronidase, invertase, xanthine oxidase (XO), firefly luciferase (LUC), and glucose oxidase (GO). The systems and compositions including a tracrRNA and methods of use thereof that are disclosed herein can also be employed with related Cas nucleases, including Csm nucleases, e.g., ObCsm1 (GenBank accession number OGX23684), SmCsm1 (GenBank accession number KF067988), MiCsm1 (GenBank accession number KKQ38176), or SuCsm1 (GenBank accession number KIM12007) (see, e.g., Begemann et al. (2017) bioRxiv, publicly available at dx[dot]doi[dot]org/10 [dot]1101/192799), nucleases having a sequence selected from the group consisting of SEQ ID NOs:115, 137, 138, and variants thereof, such as a variant ObCsm1 that differs from a wild-type ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

A Method of Integrating a Sequence Encoded by a Donor Polynucleotide at a Specific Locus Another aspect of the invention provides a method of integrating or inserting a nucleotide sequence encoded by a donor polynucleotide at a specific locus in a target DNA, wherein the method includes the steps of: (1) annealing a donor polynucleotide to a modified Cas12a ribonucleoprotein complex, wherein the modified Cas12a ribonucleoprotein complex includes: (a) a Cas12a nuclease; (b) a functional RNA molecule including a Cas12a tracrRNA and a functional RNA moiety; and (c) a Cas12a crRNA that includes a 3' extension capable of hybridizing with a segment of the functional RNA molecule; wherein the functional RNA moiety includes an RNA sequence for annealing to the donor polynucleotide; and wherein the Cas12a crRNA includes a spacer sequence that corresponds to a specific target locus in a target DNA, thus forming a donor:RNP complex; and (2) contacting the target DNA with the donor: RNP complex; whereby the nucleotide sequence encoded by the donor polynucleotide is integrated or inserted at the specific target locus in the target DNA.

In embodiments, the Cas12a nuclease that forms part of the modified Cas12a ribonucleoprotein complex is any one of the Cas12a ("Cpf1") nucleases disclosed in U.S. Pat. No. 9,790,490 or in U.S. patent application Ser. No. 15/566,528 (national phase entry of International Application No. PCT/EP2016/058442, published as WO2016166340), or in U.S. Pat. No. 9,896,696 which are specifically incorporated herein by reference. In specific embodiments, the Cas12a nuclease is a Cas12a ("Cpf1") nuclease identified from *Francisella novicida* U112 (FnCas12a or "FnCpf1"), from *Acidaminococcus* sp. BV3L6 (AsCas12a or "AsCpf1"), or from *Lachnospiraceae bacterium* ND2006 (LbCas12a or "LbCpf1"), or is an orthologue thereof, such as an orthologue having at least 50% sequence identity to FnCas12a ("FnCpf1"); see, e.g., the FnCpf1 nuclease contained in the FnCpf1 locus having SEQ ID NO:211 in U.S. Pat. No. 9,790,490, incorporated herein by reference. In embodiments, a Cas12a nuclease is (a) a Cas12a nuclease identified from the genome of a bacterial species selected from the group consisting of *Francisella tularensis* 1, *Prevotella albensis, Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, Smithella sp. SCADC, *Acidaminococcus* sp. BV3L6, *Lachnospiraceae bacterium* MA2020, *Candidatus Methanoplasma termitum, Eubacterium eligens, Moraxella bovoculi* 237, *Leptospira inadai, Lachnospiraceae bacterium* ND2006, *Porphyromonas crevioricanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, 1994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A. In embodiments, the Cas12a nuclease is deactivated. In embodiments, the Cas12a nuclease includes at least one modification selected from the group consisting of: (a) a localization or signal peptide (e.g., a nuclear localization signal (NLS), a chloroplast or plastid transit peptide (CTP), or a mitochondrial targeting peptide (MTP)); (b) a detectable label (e.g., a fluorescent dye); (c) a cell-penetrating peptide; (d) an endosomal escape peptide; and (e) an affinity tag. The methods including the use of a tracrRNA as disclosed herein can also be employed with related Cas nucleases, including Csm nucleases, e.g., ObCsm1 (GenBank accession number OGX23684), SmCsm1 (GenBank accession number KF067988), MiCsm1 (GenBank accession number KKQ38176), or SuCsm1 (GenBank accession number KIM12007) (see, e.g., Begemann et al. (2017) bioRxiv, publicly available at dx[dot]doi[dot]org/10[dot]1101/192799), nucleases having a sequence selected from the group consisting of SEQ ID NOs:115, 137, 138, and variants thereof, such as a variant ObCsm1 that differs from a wild-type ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

Embodiments of a "Cas12a tracrRNA" include an RNA molecule having the nucleotide sequence of a naturally occurring tracrRNA identified from a native Cas12a locus. For example, a naturally occurring Cas12a tracrRNA can be identified from a genome using the techniques described by Zetsche et al. (2015) Cell, 163:759-771, and in U.S. Pat. No. 9,790,490. A naturally occurring Cas12a tracrRNA can be identified from a genome as DNA sequence encoding a RNA molecule that: is predicted to be or putatively transcribed (or that may be determined to be transcribed, e.g., by RNA analysis) from a Cas12a CRISPR genomic region, specifically from a locus that flanks the DNA encoding the Cas12a CRISPR nuclease; that preferably but not necessarily includes a predicted transcriptional terminator in the direction of transcription; that is about 60 to about 100 nucleotides in length, e.g., 60-80 nucleotides, 60-85 nucleotides, 60-90 nucleotides, or 65-95 nucleotides; and that is not a direct repeat in the Cas12a CRISPR array, but rather has a nucleotide sequence that permits the transcribed tracrRNA to hybridize to the crRNA (i.e., the transcribed tracrRNA has sufficient complementarity to a crRNA sequence to hybridize to the crRNA). In embodiments, the Cas12a tracrRNA locus is directly adjacent to the DNA encoding the Cas12a nuclease. In embodiments, there is additional genomic sequence, such as DNA sequence encoding other Cas nucleases, located between the Cas12a tracrRNA locus and the DNA encoding the Cas12a nuclease; see, e.g., FIGS. 1 and 4. In embodiments, the transcribed tracrRNA has a nucleotide sequence having at least 50% identity (e.g., at least 50%, at least 51%, at least 52%, at least 53%, at least 54%, at least 55%, at least 56%, at least 57%, at least 58%, at least 59%, or at least 60% sequence identity) to the sequence of the direct repeat. In embodiments, the Cas12a tracrRNA has a sequence that is selected from the group consisting of SEQ ID NOs:1, 3, 6, 139-146, 149-169, 223-240, and 241. An alternative embodiment of a "Cas12a tracrRNA" includes an RNA molecule having or including a nucleotide sequence based on the nucleotide sequence of a naturally occurring tracrRNA identified from a native Cas12a locus. Examples include RNA molecules that include the nucleotide sequence of a tracrRNA (or putative tracrRNA) identified from a native Cas12a locus but that further include one or more modifications such as (a) additional nucleotides, e.g., an extension at the 3' terminus, (b) insertion, deletion, or substitution of one or more nucleotides within the naturally occurring tracrRNA sequence, preferably maintaining the secondary structure of the tracrRNA, and (c) chemical modifications, e.g., addition of a detectable label.

In embodiments, the functional RNA moiety includes an RNA sequence for annealing to the donor polynucleotide. The RNA sequence for annealing to the donor polynucleotide has a length and degree of sequence identity that in combination are sufficient to allow hybridization of the functional RNA moiety and the donor polynucleotide at physiological conditions. For convenience and economy, in some embodiments, the RNA sequence for annealing to the donor polynucleotide is short, about 10 nucleotides in length, and has exact (100%) sequence complementarity to a segment of the donor polynucleotide of equivalent length. In other embodiments, the RNA sequence for annealing to the donor polynucleotide is greater than 10 nucleotides in length, and has at least 50%, at least 60%, at least 70%, at least 80%, at least 90%, or at least 95% sequence complementarity to a segment of the donor polynucleotide of equivalent length.

In embodiments, the donor polynucleotide includes single-stranded DNA, optionally including chemical modifications. In other embodiments, the donor polynucleotide includes double-stranded DNA, optionally including chemical modifications. In some embodiments, the donor polynucleotide includes both DNA and RNA, for example as a duplex formed by a DNA strand and an RNA strand. In embodiments, the donor polynucleotide is designed to include a template for genome editing via homology-dependent repair (HDR); the template generally includes a "core sequence" that is to replace a sequence of the genome of about the same size, as well as "homology arms" that flank the core sequence on either side and have a sequence complementary to the genomic regions flanking the genomic sequence to be replaced or edited. In other embodiments, the donor polynucleotide does not include homology arms or does not include a core sequence and homology arms, for example in embodiments where the donor polynucleotide is used to make a deletion.

In general, a donor polynucleotide including a template encoding a nucleotide change over a region of less than about 50 nucleotides is conveniently provided in the form of single-stranded DNA; larger donor templates (e.g., more than 100 nucleotides) are often conveniently provided as double-stranded DNAs. Thus in some embodiments, the donor polynucleotide is about 25 nucleotides, 50 nucleotides, 60 nucleotides, 70 nucleotides 80 nucleotides, 90 nucleotides, 100 nucleotides, 200 nucleotides, 300 nucleotides, 400 nucleotides, 500 nucleotides, 600 nucleotides, 700 nucleotides, 800 nucleotides, 900 nucleotides, 1000 nucleotides, 1200 nucleotides, 1500 nucleotides, 1800 nucleotides, 2000 nucleotides, 2500 nucleotides, 3000 nucleotides, 5000 nucleotides, 10,000 nucleotides, or more (such as about 25-200 nucleotides, 50-300 nucleotides, 100-500 nucleotides, 200-800 nucleotides, 700-2000 nucleotides, 1000-2500 nucleotides, 2000-5000 nucleotides, 4000-8000 nucleotides, or 6000-10,000 nucleotides).

The target DNA or target sequence (i.e., the DNA to be edited) is in many embodiments genomic DNA or chromosomal DNA of a eukaryotic cell or eukaryotic organism. In embodiments, the target DNA is mitochondrial DNA or plastid DNA. In embodiments, the target DNA includes recombinant DNA, for example, a transgene stably integrated in the genome of a eukaryote, such as of a plant. Target sequences and eukaryotic cells are described in detail below under the section headed "Related Disclosure".

DNA Expression Systems (I)

Another aspect of the invention provides a DNA expression system including: (a) DNA sequence for a first promoter; and (b) operably linked and heterologous to the first promoter, a DNA sequence encoding a first RNA molecule including a Cas12a tracrRNA and including a restriction endonuclease cleavage site that is suitable for insertion of a sequence coding for a functional RNA moiety.

The first promoter is heterologous to the DNA encoding a first RNA molecule including a Cas12a tracrRNA and including a restriction endonuclease cleavage site. The first promoter is selected for operability in the context (in vitro or in vivo) in which the DNA expression system is to be used. Thus, in certain embodiments, the first promoter is a promoter that functions in prokaryotic cells, such as in bacterial cells. In preferred embodiments, the first promoter is a promoter that functions in eukaryotic cells, such as in non-human animal (e.g., mammalian, human) or human or plant or fungal cells; in embodiments, the first promoter is one identified from a eukaryotic genome, such as a non-human animal or human or plant or fungal genome. In embodiments, the first promoter is a promoter selected from the group consisting of pol III promoters, pol II promoters, and pol I promoters. In embodiments, the first promoter is a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter. For use in plants, useful promoters include constitutive, conditional, inducible, and temporally or spatially specific promoters (e.g., a tissue specific promoter, a developmentally regulated promoter, or a cell cycle regulated promoter). In embodiments, the promoter is a pol II promoter. In embodiments, the promoter is a constitutive promoter that drives DNA expression in plant cells; in embodiments, the promoter drives DNA expression in the nucleus or in an organelle such as a chloroplast or mitochondrion. Examples of constitutive promoters include a CaMV 35S promoter as disclosed in U.S. Pat. Nos. 5,858,742 and 5,322,938, a rice actin promoter as disclosed in U.S. Pat. No. 5,641,876, a maize chloroplast aldolase promoter as disclosed in U.S. Pat. No. 7,151,204, and an opaline synthase (NOS) and octapine synthase (OCS) promoter from *Agrobacterium tumefaciens*. In embodiments, the promoter is a promoter from figwort mosaic virus (FMV), a RUBISCO promoter, or a pyruvate phosphate dikinase (PDK) promoter, which is active in the chloroplasts of mesophyll cells. Other contemplated promoters include cell-specific or tissue-specific or developmentally regulated promoters, for example, a promoter that limits the expression of the DNA expression system to germline or reproductive cells (e.g., promoters of genes encoding DNA ligases, recombinases, replicases, or other genes specifically expressed in germline or reproductive cells). In embodiments, the first promoter is a plant U6 spliceosomal RNA promoter, which can be native to the genome of the plant cell or from a different species, e.g., a U6 promoter from maize, tomato, or soybean such as those disclosed in U.S. patent application Ser. No. 15/120,110, published as U.S. Patent Application Publication 2017/0166912, national phase application claiming priority to PCT/US2015/018104 (published as WO 2015/131101 and claiming priority to U.S. Provisional Patent Application 61/945,700), or a homologue thereof, in an example, such a promoter is operably linked to DNA sequence encoding a first RNA molecule including a Cas12a tracrRNA and including a restriction endonuclease cleavage site that is suitable for insertion of a sequence coding for a functional RNA moiety, followed by a suitable 3' element such as a U6 poly-T terminator. In another embodiment, the first promoter is a plant U3, 7SL (signal recognition particle RNA), U2, or U5 promoter, or chimerics thereof, e.g., as described in U.S. patent application Ser. No. 15/120,110, published as U.S. Patent Application Publication 2017/0166912, national phase application claiming priority to PCT/US2015/018104 (published as WO 2015/131101 and claiming priority to U.S. Provisional Patent Application 61/945,700). All of the patent publications referenced in this paragraph are incorporated herein by reference in their entirety. Additional non-limiting embodiments of promoters functional in plants are provided in Example 5.

Embodiments of a "Cas12a tracrRNA" include an RNA molecule having the nucleotide sequence of a naturally occurring tracrRNA identified from a native Cas12a locus. For example, a naturally occurring Cas12a tracrRNA can be identified from a genome using the techniques described by Zetsche et al. (2015) *Cell*, 163:759-771, and in U.S. Pat. No. 9,790,490. A naturally occurring Cas12a tracrRNA can be identified from a genome as DNA sequence encoding a RNA molecule that: is predicted to be or putatively transcribed (or that may be determined to be transcribed, e.g., by RNA analysis) from a Cas12a CRISPR genomic region, specifically from a locus that flanks the DNA encoding the Cas12a CRISPR nuclease; that preferably includes a predicted transcriptional terminator in the direction of transcription; that is about 60 to about 100 nucleotides in length, e.g., 60-80 nucleotides, 60-85 nucleotides, 60-90 nucleotides, or 65-95 nucleotides; and that is not a direct repeat in the Cas12a CRISPR array, but rather has a nucleotide sequence that permits the transcribed tracrRNA to hybridize to the crRNA (i.e., the transcribed tracrRNA has sufficient complementarity to a crRNA sequence to hybridize to the crRNA). In embodiments, the Cas12a tracrRNA locus is directly adjacent to the DNA encoding the Cas12a nuclease. In embodiments, there is additional genomic sequence, such as DNA sequence encoding other Cas nucleases, located between the Cas12a tracrRNA locus and the DNA encoding the Cas12a nuclease; see, e.g., FIGS. 1 and 4. In embodiments, the transcribed tracrRNA has a nucleotide sequence having at least 50% identity (e.g., at least 50%, at least 51%, at least 52%, at least 53%, at least 54%, at least 55%, at least 56%, at least 57%, at least 58%, at least 59%, or at least 60% sequence identity) to the sequence of the direct repeat. In embodiments, the Cas12a tracrRNA has a sequence that is selected from the group consisting of SEQ ID NOs:1, 3, 6, 139-146, 149-169, 223-240, and 241. An alternative embodiment of a "Cas12a tracrRNA" includes an RNA molecule having or including a nucleotide sequence based on the nucleotide sequence of a naturally occurring tracrRNA identified from a native Cas12a locus. Examples include RNA molecules that include the nucleotide sequence of a tracrRNA (or putative tracrRNA) identified from a native Cas12a locus but that further include one or more modifications such as (a) additional nucleotides, e.g., an extension at the 3' terminus, (b) insertion, deletion, or substitution of one or more nucleotides within the naturally occurring tracrRNA sequence, preferably maintaining the secondary structure of the tracrRNA, and (c) chemical modifications, e.g., addition of a detectable label. In embodiments of the DNA expression system, the Cas12a tracrRNA further includes a 5' extension, such as the 5' extensions disclosed by Park et al. (2018) *Nature Communications*, doi: 10.1038/s41467-018-05641-3.

In one application, the DNA expression system is useful for expression of an RNA molecule that includes a Cas12a tracrRNA and a functional RNA moiety. Thus, the DNA expression system includes a DNA sequence that encodes a first RNA molecule including a Cas12a tracrRNA, and that includes a restriction endonuclease cleavage site that is suitable for insertion of a sequence coding for an RNA moiety. In embodiments, the restriction endonuclease cleavage site is located in or adjacent to the DNA encoding the Cas12a tracrRNA. In embodiments, the restriction endonuclease cleavage site is located within the DNA encoding the Cas12a tracrRNA. In preferred embodiments, the restriction endonuclease cleavage site is located within the 3' region of the DNA encoding the Cas12a tracrRNA, or within a short distance (e.g., within about 40, about 30, about 20, or about 10 nucleotides) of the 3' end of the Cas12a tracrRNA. In many embodiments, the restriction endonuclease recognizes and binds to the DNA at the same location at which the endonuclease cuts the DNA. In some embodiments, the restriction endonuclease cleavage site (that is, where the restriction endonuclease cuts) can be at a location on the DNA at a short distance from where the restriction endonuclease recognizes and binds to the DNA. In embodiments, the restriction endonuclease cleavage site occurs natively in the Cas12a tracrRNA, that is to say, occurs in a naturally occurring DNA sequence that encodes a predicted or putative Cas12a tracrRNA. In other embodiments, the restriction endonuclease cleavage site is artificial or engineered; in a non-limiting example includes a naturally occurring DNA sequence that encodes a predicted or putative Cas12a tracrRNA and further includes at least one nucleotide that is artificially added, deleted, or substituted to provide an engineered restriction endonuclease cleavage site located in or adjacent to the sequence encoding the tracrRNA. In embodiments, the DNA expression system further includes a terminator located 3' to the DNA sequence encoding the tracrRNA.

In embodiments, the DNA expression system further includes: (a) optionally, a DNA sequence for a second promoter; (b) operably linked and heterologous to the first promoter or the second promoter, a DNA encoding a Cas12a crRNA that includes a 3' extension capable of hybridizing with a segment of the first RNA molecule (wherein the segment can be within or part of the tracrRNA that is part of the first RNA molecule); and (c) optionally, a terminator. The optional second promoter is selected for operability in the context (in vitro or in vivo) in which the DNA expression system is to be used. Thus, in certain embodiments, the second promoter is a promoter that functions in prokaryotic cells, such as in bacterial cells. In preferred embodiments, the second promoter is a promoter that functions in eukaryotic cells, such as in non-human animal (e.g., mammalian, human) or human or plant or fungal cells; in embodiments, the first promoter is one identified from a eukaryotic genome, such as a non-human animal or human or plant or fungal genome. In embodiments, the second promoter is a promoter such as those described as suitable for the first promoter. In embodiments, the first promoter and the second promoter, if present, are different promoters. In embodiments, the first promoter and the DNA encoding the first RNA molecule, and the DNA encoding a Cas12a crRNA that includes a 3' extension are contained in a single construct. In some embodiments where the DNA expression system includes the second promoter, the first promoter and the DNA encoding the first RNA molecule are contained in a first construct, and the second promoter and the DNA encoding a Cas12a crRNA that includes a 3' extension are contained in a second construct; in such embodiments, the first construct and the second construct can be provided (a) in a single vector, or (b) in separate vectors. In other embodiments, the first promoter drives expression of both the DNA encoding the first RNA molecule and the DNA encoding the Cas12a crRNA.

In embodiments where the DNA expression system further includes a terminator located 3' to the DNA sequence encoding the tracrRNA, the terminator is functional in the cell wherein the DNA expression system is to be used. By "terminator" is meant a DNA segment near the 3' end of an expression cassette that acts as a signal to terminate transcription and directs polyadenylation of the resultant mRNA. Such a 3' element is also sometimes referred to as a "3'-untranslated region" or "3'-UTR" or a "polyadenylation signal". Non-limiting embodiments of terminators functional in eukaryotic cells include a U6 poly-T terminator, an SV40 terminator, an hGH terminator, a BGH terminator, an rbGlob terminator, a synthetic terminator functional in a eukaryotic cell, a 3' element from an *Agrobacterium* sp. gene, a 3' element from a non-human animal gene, a 3' element from a human gene, and a 3' element from a plant gene, wherein the 3' element terminate transcription of an RNA transcript located immediately 5' to the 3' element. Useful 3' elements include: *Agrobacterium tumefaciens* nos 3', tml 3', tmr 3', tins 3', ocs 3', and tr7 3' elements disclosed in U.S. Pat. No. 6,090,627, incorporated herein by reference, and 3' elements from plant genes such as the heat shock protein 17, ubiquitin, and fructose-1,6-biphosphatase genes from wheat (*Triticum aestivum*), and the glutelin, lactate dehydrogenase, and beta-tubulin genes from rice (*Oryza sativa*), disclosed in U.S. Patent Application Publication 2002/0192813 A1, incorporated herein by reference. Cas12a tracrRNAs (such as putative Cas12a tracrRNAs identified as described herein) may have associated endogenous pol III terminators which can be used in the DNA expression systems disclosed herein. In embodiments, the DNA expression system includes a heterologous promoter operably linked to a DNA sequence that encodes a first RNA molecule that includes a Cas12a tracrRNA and that includes a restriction endonuclease cleavage site that is suitable for insertion of a sequence coding for an RNA moiety, and further includes an endogenous pol III terminator (e.g., the terminator naturally associated with a putative Cas12a tracrRNA), or a heterologous terminator. In preferred embodiments of the various DNA expression systems disclosed herein, the terminator is functional in a eukaryotic cell, such as a plant cell; in embodiments, the terminator is one identified from eukaryotic genomic sequence, such as a plant genomic sequence. In embodiments, the terminator has a sequence selected from the group consisting of SEQ ID NOs:72-100 or comprise a U6 poly-T terminator, an SV40 terminator, an hGH terminator, a BGH terminator, an rbGlob terminator, or a synthetic terminator functional in a eukaryotic cell.

In embodiments of the DNA expression system, the Cas12a crRNA is capable of complexing with a Cas12a nuclease to form a Cas12a ribonucleoprotein complex or system. In embodiments, the Cas12a nuclease is any one of the Cas12a ("Cpf1") nucleases disclosed in U.S. Pat. No. 9,790,490 or in U.S. patent application Ser. No. 15/566,572 (national phase entry of International Application No. PCT/EP2016/058442, published as WO2016166340), or in U.S. Pat. No. 9,896,696 which are specifically incorporated herein by reference. In specific embodiments, the Cas12a nuclease is a Cas12a ("Cpf1") nuclease identified from *Francisella novicida* U112 (FnCas12a or "FnCpf1"), from *Acidaminococcus* sp. BV3L6 (AsCas12a or "AsCpf1"), or from *Lachnospiraceae bacterium* ND2006 (LbCas12a or "LbCpf1"), or is an orthologue thereof, such as an orthologue having at least 50% sequence identity to FnCas12a ("FnCpf1"); see, e.g., the FnCpf1 nuclease contained in the FnCpf1 locus having SEQ ID NO:211 in U.S. Pat. No. 9,790,490, incorporated herein by reference. In embodiments, a Cas12a nuclease is (a) a Cas12a nuclease identified from the genome of a bacterial species selected from the group consisting of *Francisella tularensis* 1, *Prevotella albensis, Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, *Candidatus Methanoplasma termitum, Eubacterium eligens, Moraxella bovoculi* 237, *Leptospira inadai, Lachnospiraceae bacterium* ND2006, *Porphyromonas creviorica-nis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A. In embodiments, the Cas12a nuclease is deactivated. In embodiments, the Cas12a nuclease includes at least one modification selected from the group consisting of: (a) a localization signal (e.g., a nuclear localization signal, a mitochondrial localization signal, or a plastid localization signal); (b) a detectable label (e.g., a fluorescent dye); (c) a cell-penetrating peptide; (d) an endosomal escape peptide; and (e) an affinity tag. In embodiments of the DNA expression system, the first promoter has a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter and the Cas12a tracrRNA has a nucleotide sequence including a sequence selected from the group consisting of SEQ ID NOs:1, 3, 6, 139-146, 149-169, 223-240, and 241. In embodiments of the DNA expression system, the first promoter has a DNA sequence selected from the group consisting of SEQ ID NOs:16-71, the Cas12a tracrRNA has a nucleotide sequence including a sequence selected from the group consisting of SEQ ID NOs:1, 3, 6, 139-146, 149-169, 223-240, and 241, and the optional first terminator has a sequence selected from the group consisting of SEQ ID NOs:72-100 or comprise a U6 poly-T terminator, an SV40 terminator, an hGH terminator, a BGH terminator, an rbGlob terminator, or a synthetic terminator functional in a eukaryotic cell. The systems including a tracrRNA as disclosed herein can also be employed with related Cas nucleases, including Csm nucleases, e.g., ObCsm1 (GenBank accession number OGX23684), SmCsm1 (GenBank accession number KF067988), MiCsm1 (GenBank accession number KKQ38176), or SuCsm1 (GenBank accession number KIM12007) (see, e.g., Begemann et al. (2017) bioRxiv, publicly available at dx[dot]doi[dot]org/10[dot] 1101/192799), nucleases having a sequence selected from the group consisting of SEQ ID NOs:115, 137, 138, and variants thereof, such as a variant ObCsm1 that differs from a wild-type ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

DNA Expression Systems (II)

Another aspect of the invention provides a DNA expression system including: (a) DNA sequence for a first promoter; and (b) operably linked and heterologous to the first promoter, a DNA sequence encoding a functional RNA molecule including a Cas12a tracrRNA and a functional RNA moiety. In embodiments, the DNA expression system includes (a) DNA sequence for a first promoter; and (b) operably linked and heterologous to the first promoter, a DNA sequence encoding a functional RNA molecule including a Cas12a tracrRNA and a functional RNA moiety, and (c) a terminator 3' to and operably linked to the DNA encoding a functional RNA molecule. In embodiments, the DNA expression system further includes: (a) optionally, a DNA sequence for a second promoter; (b) operably linked and heterologous to the first promoter or the second promoter, a DNA encoding a Cas12a crRNA that includes a 3' extension capable of hybridizing with a segment of the functional RNA molecule; and (c) optionally, a terminator.

The first promoter is heterologous to the DNA sequence encoding a functional RNA molecule including a Cas12a tracrRNA and a functional RNA moiety. Where the DNA expression system further includes a DNA encoding a Cas12a crRNA that includes a 3' extension capable of hybridizing with a segment of the functional RNA molecule, the first promoter is also heterologous to this DNA. The optional second promoter is heterologous to the DNA encoding a Cas12a crRNA that includes a 3' extension capable of hybridizing with a segment of the functional RNA molecule. Each promoter is selected for operability in the context (in vitro or in vivo) in which the DNA expression system is to be used. Thus, in embodiments, the first promoter (and the optional second promoter) is a promoter that functions in prokaryotic cells, such as in bacterial cells. In preferred embodiments, the first promoter is a promoter that functions in eukaryotic cells, such as in non-human animal (e.g., mammalian, human) or human or plant or fungal cells; in embodiments, the first promoter is one identified from a eukaryotic genome, such as a non-human animal or human or plant or fungal genome. In embodiments, the first promoter is a promoter selected from the group consisting of pol III promoters, pol II promoters, and pol I promoters. In embodiments, the first promoter is a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter. In embodiments, the first promoter (and the optional second promoter) is a promoter that functions in eukaryotic cells, such as in plant cells. For use in plants, useful promoters include constitutive, conditional, inducible, and temporally or spatially specific promoters (e.g., a tissue specific promoter, a developmentally regulated promoter, or a cell cycle regulated promoter). In embodiments, the promoter is a pol II promoter. In embodiments, the promoter is a constitutive promoter that drives DNA expression in plant cells; in embodiments, the promoter drives DNA expression in the nucleus or in an organelle such as a chloroplast or mitochondrion. Examples of constitutive promoters include a CaMV 35S promoter as disclosed in U.S. Pat. Nos. 5,858,742 and 5,322,938, a rice actin promoter as disclosed in U.S. Pat. No. 5,641,876, a maize chloroplast aldolase promoter as disclosed in U.S. Pat. No. 7,151,204, and an opaline synthase (NOS) and octapine synthase (OCS) promoter from *Agrobacterium tumefaciens*. In embodiments, the promoter is a promoter from figwort mosaic virus (FMV), a RUBISCO promoter, or a pyruvate phosphate dikinase (PDK) promoter, which is active in the chloroplasts of mesophyll cells. Other contemplated promoters include cell-specific or tissue-specific or developmentally regulated promoters, for example, a promoter that limits the expression of the DNA expression system to germline or reproductive cells (e.g., promoters of genes encoding DNA ligases, recombinases, replicases, or other genes specifically expressed in germline or reproductive cells). In embodiments, the first promoter is a plant U6 spliceosomal RNA promoter, which can be native to the genome of the plant cell or from a different species, e.g., a U6 promoter from maize, tomato, or soybean such as those disclosed in U.S. patent application Ser. No. 15/120,110, published as U.S. Patent Application Publication 2017/0166912, national phase application claiming priority to PCT/US2015/018104 (published as WO 2015/131101 and claiming priority to U.S. Provisional Patent Application 61/945,700), or a homologue thereof, in an example, such a promoter is operably linked to DNA sequence encoding a functional RNA molecule including a Cas12a tracrRNA and a functional RNA moiety, followed by a suitable 3' element such as a U6 poly-T terminator. In another embodiment, the first promoter is a plant U3, 7SL (signal recognition particle RNA), U2, or U5 promoter, or chimerics thereof, e.g., as described in U.S. patent application Ser. No. 15/120,110, published as U.S. Patent Application Publication 2017/0166912, national phase application claiming priority to PCT/US2015/018104 (published as WO 2015/131101 and claiming priority to U.S. Provisional Patent Application 61/945,700). All of the patent publications referenced in this paragraph are incorporated herein by reference in their entirety.

Embodiments of a "Cas12a tracrRNA" include an RNA molecule having the nucleotide sequence of a naturally occurring tracrRNA identified from a native Cas12a locus. For example, a naturally occurring Cas12a tracrRNA can be identified from a genome using the techniques described by Zetsche et al. (2015) *Cell*, 163:759-771, and in U.S. Pat. No. 9,790,490. A naturally occurring Cas12a tracrRNA can be identified from a genome as DNA sequence encoding a RNA molecule that: is predicted to be or putatively transcribed (or that may be determined to be transcribed, e.g., by RNA analysis) from a Cas12a CRISPR genomic region, specifically from a locus that flanks the DNA encoding the Cas12a CRISPR nuclease; that preferably includes a predicted transcriptional terminator in the direction of transcription; that is about 60 to about 100 nucleotides in length, e.g., 60-80 nucleotides, 60-85 nucleotides, 60-90 nucleotides, or 65-95 nucleotides; and that is not a direct repeat in the Cas12a CRISPR array, but rather has a nucleotide sequence that permits the transcribed tracrRNA to hybridize to the crRNA (i.e., the transcribed tracrRNA has sufficient complementarity to a crRNA sequence to hybridize to the crRNA). In embodiments, the Cas12a tracrRNA locus is directly adjacent to the DNA encoding the Cas12a nuclease. In embodiments, there is additional genomic sequence, such as DNA sequence encoding other Cas nucleases, located between the Cas12a tracrRNA locus and the DNA encoding the Cas12a nuclease; see, e.g., FIGS. 1 and 4. In embodiments, the transcribed tracrRNA has a nucleotide sequence having at least 50% identity (e.g., at least 50%, at least 51%, at least 52%, at least 53%, at least 54%, at least 55%, at least 56%, at least 57%, at least 58%, at least 59%, or at least 60% sequence identity) to the sequence of the direct repeat. In embodiments, the Cas12a tracrRNA has a sequence that is selected from the group consisting of SEQ ID NOs:1, 3, 6, 139-146, 149-169, 223-240, and 241. An alternative embodiment of a "Cas12a tracrRNA" includes an RNA molecule having or including a nucleotide sequence based on the nucleotide sequence of a naturally occurring tracrRNA identified from a native Cas12a locus. Examples include RNA molecules that include the nucleotide sequence of a tracrRNA (or putative tracrRNA) identified from a native Cas12a locus but that further include one or more modifications such as (a) additional nucleotides, e.g., an extension at the 3' terminus, (b) insertion, deletion, or substitution of one or more nucleotides within the naturally occurring tracrRNA sequence, preferably maintaining the secondary structure of the tracrRNA, and (c) chemical modifications, e.g., addition of a detectable label. In embodiments of the DNA expression system, the Cas12a tracrRNA further includes a 5' extension, such as the 5' extensions disclosed by Park et al. (2018) *Nature Communications*, doi: 10.1038/s41467-018-05641-3.

In embodiments where the DNA expression system further includes a terminator located 3' to and operably linked to the DNA encoding a functional RNA molecule, the terminator is functional in the cell wherein the DNA expression system is to be used. By "terminator" is meant a DNA segment near the 3' end of an expression cassette that acts as a signal to terminate transcription and directs polyadenylation of the resultant mRNA. Such a 3' element is also sometimes referred to as a "3'-untranslated region" or "3'-UTR" or a "polyadenylation signal". Non-limiting embodiments of terminators functional in eukaryotic cells include a U6 poly-T terminator, an SV40 terminator, an hGH terminator, a BGH terminator, an rbGlob terminator, a synthetic terminator functional in a eukaryotic cell, a 3' element from an *Agrobacterium* sp. gene, a 3' element from a non-human animal gene, a 3' element from a human gene, and a 3' element from a plant gene, wherein the 3' element terminate transcription of an RNA transcript located immediately 5' to the 3' element. Useful 3' elements include: *Agrobacterium tumefaciens* nos 3', tml 3', tmr 3', tms 3', ocs 3', and tr7 3' elements disclosed in U.S. Pat. No. 6,090,627, incorporated herein by reference, and 3' elements from plant genes such as the heat shock protein 17, ubiquitin, and fructose-1,6-biphosphatase genes from wheat (*Triticum aestivum*), and the glutelin, lactate dehydrogenase, and beta-tubulin genes from rice (*Oryza sativa*), disclosed in U.S. Patent Application Publication 2002/0192813 A1, incorporated herein by reference. Cas12a tracrRNAs (such as putative Cas12a tracrRNAs identified as described herein) may have associated endogenous pol III terminators which can be used in the DNA expression systems disclosed herein. In embodiments, the DNA expression system includes: (a) DNA sequence for a first promoter; (b) operably linked and heterologous to the first promoter, a DNA sequence encoding a functional RNA molecule including a Cas12a tracrRNA and a functional RNA moiety; and (c) an endogenous pol III terminator (e.g., the terminator naturally associated with a putative Cas12a tracrRNA), or a heterologous terminator. In preferred embodiments of the various DNA expression systems disclosed herein, the terminator is functional in a eukaryotic cell, such as a plant cell; in embodiments, the terminator is one identified from eukaryotic genomic sequence, such as a plant genomic sequence.

In embodiments of the DNA expression system, the first promoter and the DNA encoding the functional RNA molecule, and the DNA encoding a Cas12a crRNA that includes a 3' extension are contained in a single construct. In embodiments of the DNA expression system that include the optional second promoter, the first promoter and the DNA encoding the functional RNA molecule are contained in a first construct, and the second promoter and the DNA encoding a Cas12a crRNA that includes a 3' extension are contained in a second construct; in such embodiments, the first construct and the second construct can be provided (a) in a single vector, or (b) in separate vectors. In embodiments, the first promoter drives expression of both the DNA encoding the functional RNA molecule and the DNA encoding the Cas12a crRNA.

The DNA expression system is useful for expressing a functional RNA molecule including a Cas12a tracrRNA and a functional RNA moiety. Non-limiting embodiments of functional RNA moieties include: (a) an RNA sequence for annealing to a donor polynucleotide (e.g., a single- or double-stranded DNA containing a nucleotide template for HDR-mediated editing, or a single- or double-stranded polynucleotide including a nucleotide sequence to be integrated by an NHEJ mechanism at a double-stranded break effected, for example, by the Cas12a nuclease); (b) an RNA sequence for annealing to the crRNA 3' extension; (c) a terminator sequence; (d) an RNA aptamer; (e) a ribozyme or catalytically active RNA; (f) a detectable label, such as a fluorescent tag; (g) a bar-coding sequence, or short nucleotide sequence useful for marking and identifying DNA that contains the bar-coding sequence; and (h) an RNA sequence forming at least partially double-stranded RNA. In an embodiment, the functional RNA moiety includes RNA forming at least partially double-stranded RNA capable of silencing a gene (e.g., RNA that forms one or more stem-loops where the stem includes double-stranded RNA of at least about 18 base-pairs designed to silence a target gene, or RNA that has the secondary structure of a microRNA precursor and is processed to a mature microRNA designed to silence a target gene). Non-limiting examples of RNA aptamers include an MS2 aptamer (see Parrott et al. (2000) *Nucleic Acids Res.*, 28(2):489-497), an ARiBo tag (see Di Tomasso et al. (2011) *Nucleic Acids Res.*, 39(3):e18; doi: 10.1093/nar/gkq1084), a streptavidin-binding aptamer (see Leppek and Stoecklin (2014) *Nucleic Acids Res.*, 452(2):e13; doi: 10.1093/nar/gkt956), a Csy4 aptamer (see Lee et al. (2013) *Proc. Natl. Acad. Sci. USA*, 110(14):5416-5421; doi: 10.1073/pnas.1302807110, and a Sephadex aptamer (see Srisawat and Engelke (2002) *Methods*, 26(2):156-161; doi: 10.1016/S1046-2023(02)00018-X. Many aptamers are useful for affinity purification and tagging; for example, a two-element affinity tag useful for preparing large quantities of RNA includes a variant of the hepatitis delta virus (H6V) ribozyme that is activated by imidazole and a hairpin loop from a thermostable SRP RNA that forms a high-affinity and kinetically stable complex with the *Thermotoga maritima* Ffh-M domain protein (see Keift and Batey (2004) *RNA*, 10(6): 988-995; doi: 10.1261/ma.7040604).

In embodiments of the DNA expression system, the Cas12a crRNA is capable of complexing with a Cas12a nuclease to form a Cas12a ribonucleoprotein complex containing the functional RNA molecule including a Cas12a tracrRNA and a functional RNA moiety. In embodiments, the Cas12a nuclease is any one of the Cas12a ("Cpf1") nucleases disclosed in U.S. Pat. No. 9,790,490 or in U.S. patent application Ser. No. 15/566,528 (national phase entry of International Application No. PCT/EP2016/058442, published as WO2016166340), or in U.S. Pat. No. 9,896,696 which are specifically incorporated herein by reference. In specific embodiments, the Cas12a nuclease is a Cas12a ("Cpf1") nuclease identified from *Francisella novicida* U112 (FnCas12a or "FnCpf1"), from *Acidaminococcus* sp. BV3L6 (AsCas12a or "AsCpf1"), or from *Lachnospiraceae bacterium* ND2006 (LbCas12a or "LbCpf1"), or is an orthologue thereof, such as an orthologue having at least 50% sequence identity to FnCas12a ("FnCpf1"); see, e.g., the FnCpf1 nuclease contained in the FnCpf1 locus having SEQ ID NO:211 in U.S. Pat. No. 9,790,490, specifically incorporated herein by reference. In embodiments, a Cas12a nuclease is (a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, Smithella sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, 1994L, T1006K, 11014V, V1055N/D, L1065F/Y, Y1180F, V1209G, 11229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A. In embodiments, the Cas12a nuclease is deactivated. In embodiments, the Cas12a nuclease includes at least one modification selected from the group consisting of: (a) a localization signal (e.g., a nuclear localization signal, a mitochondrial localization signal, or a plastid localization signal); (b) a detectable label (e.g., a fluorescent dye); (c) a cell-penetrating peptide; (d) an endosomal escape peptide; and (e) an affinity tag. In embodiments of the DNA expression system, the first promoter has a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter and the Cas12a tracrRNA has a nucleotide sequence including a sequence selected from the group consisting of SEQ ID NOs:1, 3, 6, 139-146, 149-169, 223-240, and 241. In embodiments of the DNA expression system, the first promoter has a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter, the Cas12a tracrRNA has a nucleotide sequence including a sequence selected from the group consisting of SEQ ID NOs:1, 3, 6, 139-146, 149-169, 223-240, and 241, and the optional first terminator has a sequence selected from the group consisting of SEQ ID NOs:72-100 or comprise a U6 poly-T terminator, an SV40 terminator, an hGH terminator, a BGH terminator, an rbGlob terminator, or a synthetic terminator functional in a eukaryotic cell. The systems including a tracrRNA as disclosed herein can also be employed with related Cas nucleases, including Csm nucleases, e.g., ObCsm1 (GenBank accession number OGX23684), SmCsm1 (GenBank accession number KF067988), MiCsm1 (GenBank accession number KKQ38176), or SuCsm1 (GenBank accession number KIM12007) (see, e.g., Begemann et al. (2017) bioRxiv, publicly available at dx[dot]doi[dot]org/10[dot]1101/192799), nucleases having a sequence selected from the group consisting of SEQ ID NOs:115, 137, 138, and variants thereof, such as a variant ObCsm1 that differs from a wild-type ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

Engineered Systems

Another aspect of the invention provides a first engineered system including: (a) a Cas12a nuclease; and (b) at least one engineered Cas12a crRNA, or a polynucleotide encoding the engineered Cas12a crRNA, wherein the engineered Cas12a crRNA includes (i) at least one direct repeat sequence or fragment thereof that is capable of associating with the Cas12a nuclease, and (ii) a spacer sequence that is designed to hybridize with a target sequence in a eukaryotic cell, wherein the at least one direct repeat sequence or fragment thereof is adjacent to and 5' to the spacer sequence; and (c) a Cas12a tracrRNA including a nucleotide sequence that has at least 50% complementarity with, the nucleotide sequence of the at least one direct repeat of the engineered Cas12a crRNA.

In another aspect, the invention provides a second engineered system including: (a) a Cas12a nuclease; and (b) at least one engineered Cas12a crRNA, or a polynucleotide encoding the engineered Cas12a crRNA, wherein the engineered Cas12a crRNA includes (i) at least one direct repeat sequence or fragment thereof that is capable of associating with the Cas12a nuclease, and (ii) a spacer sequence that is designed to hybridize with a target sequence in a eukaryotic cell, wherein the at least one direct repeat sequence or fragment thereof is adjacent to and 5' to the spacer sequence; and (c) a Cas12a tracrRNA including a naturally occurring putative Cas12a tracrRNA sequence that is identified from the same genomic region as the Cas12a nuclease by at least the following steps: (i) identifying in the genomic region flanking the DNA encoding the Cas12a nuclease at least one nucleotide sequence that includes a CRISPR array including direct repeats, and (ii) identifying as a putative Cas12a tracrRNA at least one nucleotide sequence in either the sense or antisense direction in the genomic region flanking the DNA encoding the Cas12a nuclease, wherein the putative Cas12a tracrRNA has a nucleotide sequence that has at least 50% complementarity with, the nucleotide sequence of the direct repeat.

In embodiments of the first or second engineered systems, the Cas12a nuclease is (a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, Smithella sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A. In embodiments, the Cas12a nuclease is deactivated. In embodiments, the Cas12a nuclease includes at least one modification selected from the group consisting of: (a) a localization signal (e.g., a nuclear localization signal, a mitochondrial localization signal, or a plastid localization signal); (b) a detectable label (e.g., a fluorescent dye); (c) a cell-penetrating peptide; (d) an endosomal escape peptide; and (e) an affinity tag. The systems including a tracrRNA as disclosed herein can also be employed with related Cas nucleases, including Csm nucleases, e.g., ObCsm1 (GenBank accession number OGX23684), SmCsm1 (GenBank accession number KF067988), MiCsm1 (GenBank accession number KKQ38176), or SuCsm1 (GenBank accession number KIM12007) (see, e.g., Begemann et al. (2017) bioRxiv, publicly available at dx[dot]doi[dot]org/10[dot]1101/ 192799), nucleases having a sequence selected from the group consisting of SEQ ID NOs:115, 137, 138, and 137, and variants thereof, such as a variant ObCsm1 that differs from a wild-type ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

In embodiments of the first or second engineered systems, the Cas12a tracrRNA includes a nucleotide sequence that has at least 50% complementarity with, the nucleotide sequence of the at least one direct repeat of the engineered Cas12a crRNA; such a Cas12a tracrRNA can include a naturally occurring putative Cas12a tracrRNA sequence identified from a native Cas12a locus. For example, a naturally occurring putative Cas12a tracrRNA sequence can be identified from a genome using the techniques described by Zetsche et al. (2015) Cell, 163:759-771, and in U.S. Pat. No. 9,790,490. A naturally occurring putative Cas12a tracrRNA sequence can be identified from a genome as DNA sequence encoding a RNA molecule that: is predicted to be or putatively transcribed (or that may be determined to be transcribed, e.g., by RNA analysis) from a Cas12a CRISPR genomic region, specifically from a locus that flanks the DNA encoding the Cas12a CRISPR nuclease; that preferably includes a predicted transcriptional terminator in the direction of transcription; that is about 60 to about 100 nucleotides in length, e.g., 60-80 nucleotides, 60-85 nucleotides, 60-90 nucleotides, or 65-95 nucleotides; and that is not a direct repeat in the Cas12a CRISPR array, but rather has a nucleotide sequence that permits the transcribed tracrRNA to hybridize to the crRNA (i.e., the naturally occurring putative Cas12a tracrRNA sequence has sufficient complementarity to a crRNA sequence to hybridize to the crRNA). In embodiments, the Cas12a tracrRNA locus is directly adjacent to the DNA encoding the Cas12a nuclease. In embodiments, there is additional genomic sequence, such as DNA sequence encoding other Cas nucleases, located between the Cas12a tracrRNA locus and the DNA encoding the Cas12a nuclease; see, e.g., FIGS. 1 and 4. In embodiments, the naturally occurring putative Cas12a tracrRNA sequence has a nucleotide sequence having at least 50% identity (e.g., at least 50%, at least 51%, at least 52%, at least 53%, at least 54%, at least 55%, at least 56%, at least 57%, at least 58%, at least 59%, or at least 60% sequence identity) to the sequence of the direct repeat. In embodiments of the first or second engineered systems, the Cas12a tracrRNA has a nucleotide sequence including a sequence selected from the group consisting of SEQ ID NOs:1, 3, 6, 139-146, 149-169, 223-240, and 241. An alternative embodiment of a "Cas12a tracrRNA" includes an RNA molecule having or including a nucleotide sequence based on the nucleotide sequence of a naturally occurring putative Cas12a tracrRNA sequence identified from a native Cas12a locus. Examples include RNA molecules that include the nucleotide sequence of a naturally occurring putative Cas12a tracrRNA sequence identified from a native Cas12a locus but that further include one or more modifications such as (a) additional nucleotides, e.g., an extension at the 3' terminus, (b) insertion, deletion, or substitution of one or more nucleotides within the naturally occurring tracrRNA sequence, preferably maintaining the secondary structure of the tracrRNA, and (c) chemical modifications, e.g., addition of a detectable label. In embodiments of the first or second engineered systems, the Cas12a tracrRNA further includes a 5' extension, such as the 5' extensions disclosed by Park et al. (2018) Nature Communications, doi: 10.1038/s41467-018-05641-3.

In embodiments of the first or second engineered systems, the engineered Cas12a crRNA includes a spacer sequence that is designed to hybridize with a target sequence in a eukaryotic cell. Target sequences and eukaryotic cells are described in detail below under the section headed "Related Disclosure". In embodiments of the first or second engineered systems, the "polynucleotide encoding the engineered Cas12a crRNA" is a naturally occurring polynucleotide, e.g., a pre-processed transcript that includes at least the Cas12a crRNA and often includes additional nucleotides that are removed during processing. In embodiments of the first or second engineered systems, the "polynucleotide encoding the engineered Cas12a crRNA" is an engineered or recombinant polynucleotide. In embodiments of the first or second engineered systems, the engineered Cas12a crRNA, or the polynucleotide encoding the engineered Cas12a crRNA, further includes at least one direct repeat sequence or fragment thereof capable of associating with the Cas12a nuclease, wherein the at least one direct repeat sequence or fragment thereof is adjacent to and 3' to the spacer sequence. In some embodiments of the first or second engineered systems wherein the engineered Cas12a crRNA further includes at least one direct repeat sequence or fragment thereof capable of associating with the Cas12a nuclease, wherein the at least one direct repeat sequence or fragment thereof is adjacent to and 3' to the spacer sequence, the Cas12a tracrRNA has a nucleotide sequence that has at least about 50% or preferably greater than 50% complementarity to the at least one direct repeat sequence or fragment adjacent to and 3' to the spacer sequence.

In embodiments of the first or second engineered systems, the engineered Cas12a crRNA, or the polynucleotide encoding the engineered Cas12a crRNA, further includes: (a) at least one direct repeat sequence or fragment thereof capable of associating with the Cas12a nuclease, wherein the at least one direct repeat sequence or fragment thereof is adjacent to and 3' to the spacer sequence; and (b) a 3'extension adjacent to the spacer sequence. In embodiments of the first or second engineered systems, the 3' extension includes nucleotides that when base-paired form about one helical turn. In embodiments of the first or second engineered systems, the 3' extension includes at least 10 contiguous nucleotides. In embodiments of the first or second engineered systems wherein the engineered Cas12a crRNA further includes a 3' extension adjacent to the spacer sequence, the Cas12a tracrRNA includes a nucleotide sequence having sufficient complementarity (e.g., about 50% or greater than 50%) to the engineered Cas12a crRNA's 3' extension to allow hybridization between the tracrRNA and the engineered Cas12a crRNA. In embodiments, the polynucleotide encoding the engineered Cas12a crRNA is a pre-processed Cas12a crRNA precursor transcript that includes, in 5' to 3' direction, a first direct repeat or fragment thereof, the spacer, and a 3' extension; in some embodiments, the 3' extension includes a second direct repeat or fragment thereof, and/or includes at least 10 contiguous nucleotides, and/or includes nucleotides that when base-paired form about one helical turn; in some embodiments, such a pre-processed Cas12a crRNA precursor transcript is processed (e.g., in vivo or in vitro), resulting in a processed Cas12a crRNA that has had the 3' extension nucleotides excised.

In another aspect, the invention provides a third engineered system including: (a) one or more nucleotide sequences encoding a Cas12a nuclease; and (b) one or more nucleotide sequences encoding at least one engineered Cas12a crRNA that is designed to form a complex with the Cas12a nuclease and that includes a spacer sequence designed to hybridize with a target sequence in a eukaryotic cell; and (c) one or more nucleotide sequences encoding at least one Cas12a tracrRNA.

In another aspect, the invention provides a fourth engineered system including: (a) a Cas12a nuclease, or one or more DNA or RNA nucleotide sequences encoding the Cas12a nuclease; and (b) at least one engineered Cas12a crRNA designed to form a complex with the Cas12a nuclease and including a spacer sequence designed to hybridize with a target sequence in a eukaryotic cell, or one or more DNA or RNA nucleotide sequences encoding the at least one engineered Cas12a crRNA polynucleotide; and (c) at least one tracrRNA, or one or more DNA or RNA nucleotide sequences encoding the at least one Cas12a tracrRNA.

In embodiments of the third or fourth engineered systems, the Cas12a nuclease is (a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, *Peregrinibacteria bacterium* GW2011_GWA2_33_10, *Parcubacteria bacterium* GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, 1994L, T1006K, 11014V, V1055N/D, L1065F/Y, Y1180F, V1209G, 11229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A. In embodiments, the Cas12a nuclease is deactivated. In embodiments, the Cas12a nuclease includes at least one modification selected from the group consisting of: (a) a localization signal (e.g., a nuclear localization signal, a mitochondrial localization signal, or a plastid localization signal); (b) a detectable label (e.g., a fluorescent dye); (c) a cell-penetrating peptide; (d) an endosomal escape peptide; and (e) an affinity tag. The systems including a tracrRNA as disclosed herein can also be employed with related Cas nucleases, including Csm nucleases, e.g., ObCsm1 (GenBank accession number OGX23684), SmCsm1 (GenBank accession number KF067988), MiCsm1 (GenBank accession number KKQ38176), or SuCsm1 (GenBank accession number KIM12007) (see, e.g., Begemann et al. (2017) bioRxiv, publicly available at dx[dot]doi[dot]org/10[dot]1101/192799), nucleases having a sequence selected from the group consisting of SEQ ID NOs:115, 137, 138, and variants thereof, such as a variant ObCsm1 that differs from a wild-type ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

In embodiments of the third or fourth engineered systems, the engineered Cas12a crRNA includes a spacer sequence that is designed to hybridize with a target sequence in a eukaryotic cell. Target sequences and eukaryotic cells are described in detail below under the section headed "Related Disclosure". In embodiments of the third or fourth engineered systems, the "polynucleotide encoding the engineered Cas12a crRNA" is a naturally occurring polynucleotide, e.g., a pre-processed transcript that includes at least the Cas12a crRNA and often includes additional nucleotides that are removed during processing. In embodiments of the third or fourth engineered systems, the "polynucleotide encoding the engineered Cas12a crRNA" is an engineered or recombinant polynucleotide. In embodiments of the third or fourth engineered systems, the at least one engineered Cas12a crRNA, or a polynucleotide encoding the at least one engineered Cas12a crRNA, further includes at least one direct repeat sequence or fragment thereof capable of associating with the Cas12a nuclease, wherein the at least one direct repeat sequence or fragment thereof is adjacent to and 3' to the spacer sequence. In embodiments of the third or fourth engineered systems, the engineered Cas12a crRNA, or a polynucleotide encoding the engineered Cas12a crRNA, further includes at least one direct repeat sequence or fragment thereof capable of associating with the Cas12a nuclease, wherein the at least one direct repeat sequence or fragment thereof is adjacent to and 3' to the spacer sequence. In embodiments of the third or fourth engineered systems where the engineered Cas12a crRNA further includes at least one direct repeat sequence or fragment thereof capable of associating with the Cas12a nuclease, wherein the at least one direct repeat sequence or fragment thereof is adjacent to and 3' to the spacer sequence, the Cas12a tracrRNA has a nucleotide sequence that has at least about 50% or preferably greater than 50% complementarity to the at least one direct repeat sequence or fragment adjacent to and 3' to the spacer sequence. In embodiments of the third or fourth engineered systems, the engineered Cas12a crRNA further includes a 3' extension adjacent to the spacer sequence; in some embodiments, the 3' extension includes nucleotides that when base-paired form about one helical turn; in some embodiments, the 3' extension includes at least 10 contiguous nucleotides. In embodiments of the third or fourth engineered systems where the engineered Cas12a crRNA further includes a 3' extension adjacent to the spacer sequence, the Cas12a tracrRNA has a nucleotide sequence having sufficient complementarity (e.g., about 50% or greater than 50%) to the engineered Cas12a crRNA's 3' extension to allow hybridization between the Cas12a tracrRNA and the engineered Cas12a crRNA.

In embodiments of the third or fourth engineered systems, the at least one tracrRNA, or the one or more nucleotide sequences encoding the at least one Cas12a tracrRNA, includes a nucleotide sequence that has at least 50% complementarity with, the nucleotide sequence of the at least one direct repeat of the engineered Cas12a crRNA. In embodiments of the third or fourth engineered systems, the at least one tracrRNA, or the one or more nucleotide sequences encoding the at least one Cas12a tracrRNA, includes a nucleotide sequence of a naturally occurring putative Cas12a tracrRNA sequence identified from a native Cas12a locus, such as a nucleotide sequence of a naturally occurring putative Cas12a tracrRNA sequence identified from a genome using the techniques described by Zetsche et al. (2015) *Cell,* 163:759-771, and in U.S. Pat. No. 9,790,490. A naturally occurring putative Cas12a tracrRNA sequence can be identified from a genome as DNA sequence encoding a RNA molecule that: is predicted to be or putatively transcribed (or that may be determined to be transcribed, e.g., by RNA analysis) from a Cas12a CRISPR genomic region, specifically from a locus that flanks the DNA encoding the Cas12a CRISPR nuclease; that preferably includes a predicted transcriptional terminator in the direction of transcription; that is about 60 to about 100 nucleotides in length, e.g., 60-80 nucleotides, 60-85 nucleotides, 60-90 nucleotides, or 65-95 nucleotides; and that is not a direct repeat in the Cas12a CRISPR array, but rather has a nucleotide sequence that permits the transcribed tracrRNA to hybridize to the crRNA (i.e., the naturally occurring putative Cas12a tracrRNA sequence has sufficient complementarity to a crRNA sequence to hybridize to the crRNA). In embodiments, the Cas12a tracrRNA locus is directly adjacent to the DNA encoding the Cas12a nuclease. In embodiments, there is additional genomic sequence, such as DNA sequence encoding other Cas nucleases, located between the Cas12a tracrRNA locus and the DNA encoding the Cas12a nuclease; see, e.g., FIGS. 1 and 4. In embodiments of the third or fourth engineered systems, the at least one tracrRNA, or the one or more nucleotide sequences encoding the at least one Cas12a tracrRNA, has a nucleotide sequence having at least 50% identity (e.g., at least 50%, at least 51%, at least 52%, at least 53%, at least 54%, at least 55%, at least 56%, at least 57%, at least 58%, at least 59%, or at least 60% sequence identity) to the sequence of the direct repeat. In embodiments of the third or fourth engineered systems, the at least one tracrRNA, or the one or more nucleotide sequences encoding the at least one Cas12a tracrRNA, has a nucleotide sequence including a sequence selected from the group consisting of SEQ ID NOs:1, 3, 6, 139-146, 149-169, 223-240, and 241. An alternative embodiment of a "Cas12a tracrRNA" includes an RNA molecule having or including a nucleotide sequence based on the nucleotide sequence of a naturally occurring putative Cas12a tracrRNA sequence identified from a native Cas12a locus. Examples include RNA molecules that include the nucleotide sequence of a naturally occurring putative Cas12a tracrRNA sequence identified from a native Cas12a locus but that further include one or more modifications such as (a) additional nucleotides, e.g., an extension at the 3' terminus, (b) insertion, deletion, or substitution of one or more nucleotides within the naturally occurring tracrRNA sequence, preferably maintaining the secondary structure of the tracrRNA, and (c) chemical modifications, e.g., addition of a detectable label. In embodiments of the third or fourth engineered systems, the at least one tracrRNA, or the one or more nucleotide sequences encoding the at least one Cas12a tracrRNA, further includes a 5' extension, such as the 5' extensions disclosed by Park et al. (2018) *Nature Communications,* doi: 10.1038/s41467-018-05641-3.

In another aspect, the invention provides a fifth engineered system including one or more vectors including: (a) a first regulatory element that is heterologous to and operably linked to one or more nucleotide sequences encoding a Cas12a nuclease; and (b) a second regulatory element that is heterologous to and operably linked to one or more nucleotide sequences encoding at least one engineered Cas12a crRNA that is designed to form a complex with the Cas12a nuclease and that includes a spacer sequence designed to hybridize with a target sequence in a eukaryotic cell; and (c) a third regulatory element that is heterologous to and operably linked to one or more nucleotide sequences encoding at least one Cas12a tracrRNA; wherein components (a) and (b) and (c) are located on the same vector or on different vectors of the system.

In embodiments of the fifth engineered system, the first regulatory element, the second regulatory element, and the third regulatory element each include a promoter that is functional in the eukaryotic cell. Each promoter is selected for operability in the context (in vitro or in vivo) in which the DNA expression system is to be used. Thus, in embodiments, the first regulatory element, the second regulatory element, and the third regulatory element each include a promoter that functions in prokaryotic cells, such as in bacterial cells. In preferred embodiments, the first regulatory element, the second regulatory element, and the third regulatory element each include a promoter that functions in eukaryotic cells, such as in non-human animal (e.g., mammalian, human) or human or plant or fungal cells; in embodiments, the first regulatory element, the second regulatory element, and the third regulatory element each include a promoter identified from a eukaryotic genome, such as a non-human animal or human or plant or fungal genome. In embodiments of the fifth engineered system, any one or more of the regulatory elements also includes other elements that regulate expression, such as, but not limited to, enhancers and introns, examples of which are provided in Table 3. In embodiments of the fifth engineered system, the first regulatory element, the second regulatory element, and the third regulatory element each include a promoter selected from the group consisting of pol III promoters, pol II promoters, and pol I promoters. In embodiments of the fifth engineered system, the first regulatory element, the second regulatory element, and the third regulatory element each include a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter. In embodiments, the first regulatory element, the second regulatory element, and the third regulatory element each include a promoter selected from the group consisting of pol III promoters, pol II promoters, and pol I promoters. In embodiments, the first regulatory element, the second regulatory element, and the third regulatory element each include a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, an EF1a promoter. In embodiments, the first regulatory element, the second regulatory element, and the third regulatory element each include a promoter that functions in eukaryotic cells, such as in plant cells. For use in plants, useful promoters include constitutive, conditional, inducible, and temporally or spatially specific promoters (e.g., a tissue specific promoter, a developmentally regulated promoter, or a cell cycle regulated promoter). In embodiments, the promoter is a pol II promoter. In embodiments, the promoter is a constitutive promoter that drives DNA expression in plant cells; in embodiments, the promoter drives DNA expression in the nucleus or in an organelle such as a chloroplast or mitochondrion. Examples of constitutive promoters include a CaMV 35S promoter as disclosed in U.S. Pat. Nos. 5,858,742 and 5,322,938, a rice actin promoter as disclosed in U.S. Pat. No. 5,641,876, a maize chloroplast aldolase promoter as disclosed in U.S. Pat. No. 7,151,204, and an opaline synthase (NOS) and octapine synthase (OCS) promoter from *Agrobacterium tumefaciens*. In embodiments, the promoter is a promoter from figwort mosaic virus (FMV), a RUBISCO promoter, or a pyruvate phosphate dikinase (PDK) promoter, which is active in the chloroplasts of mesophyll cells. Other contemplated promoters include cell-specific or tissue-specific or developmentally regulated promoters, for example, a promoter that limits the expression of the DNA expression system to germline or reproductive cells (e.g., promoters of genes encoding DNA ligases, recombinases, replicases, or other genes specifically expressed in germline or reproductive cells). In embodiments, the first regulatory element, the second regulatory element, and/or the third regulatory element includes a plant U6 spliceosomal RNA promoter, which can be native to the genome of the plant cell or from a different species, e.g., a U6 promoter from maize, tomato, or soybean such as those disclosed in U.S. patent application Ser. No. 15/120,110, published as U.S. Patent Application Publication 2017/0166912, national phase application claiming priority to PCT/US2015/018104 (published as WO 2015/131101 and claiming priority to U.S. Provisional Patent Application 61/945,700), or a homologue thereof, in an embodiment of the fifth engineered system, such a promoter is operably linked to DNA sequence encoding one or more nucleotide sequences encoding at least one Cas12a tracrRNA, followed by a suitable 3' element such as a U6 poly-T terminator. In another embodiment, the first promoter is a plant U3, 7SL (signal recognition particle RNA), U2, or U5 promoter, or chimerics thereof, e.g., as described in U.S. patent application Ser. No. 15/120,110, published as U.S. Patent Application Publication 2017/0166912, national phase application claiming priority to PCT/US2015/018104 (published as WO 2015/131101 and claiming priority to U.S. Provisional Patent Application 61/945,700). All of the patent publications referenced in this paragraph are incorporated herein by reference in their entirety. In embodiments of the fifth engineered system, the eukaryotic cell is a plant cell, and wherein the third regulatory element includes a promoter having a nucleotide sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter. In embodiments of the fifth engineered system, the at least one Cas12a tracrRNA is at least one Cas12a tracrRNA having a nucleotide sequence including a sequence selected from the group consisting of SEQ ID NOs:1, 3, 6, 139-146, 149-169, 223-240, and 241. In specific embodiments of the fifth engineered system, the eukaryotic cell is a plant cell, the third regulatory element includes a promoter having a nucleotide sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter, and the at least one Cas12a tracrRNA is at least one Cas12a tracrRNA having a nucleotide sequence including a sequence selected from the group consisting of SEQ ID NOs:1, 3, 6, 139-146, 149-169, 223-240, and 241.

In embodiments of the fifth engineered system, the Cas12a nuclease is (a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, 1994L, T1006K, 11014V, V1055N/D, L1065F/Y, Y1180F, V1209G, 11229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1 107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of 1339P, L342F, Q588K, F1017Q, K1047E, N1118D, F1128Y, L867I, D917A, E1006A, and D1255A. In embodiments, the Cas12a nuclease is deactivated. In embodiments, the Cas12a nuclease includes at least one modification selected from the group consisting of: (a) a localization signal (e.g., a nuclear localization signal, a mitochondrial localization signal, or a plastid localization signal); (b) a detectable label (e.g., a fluorescent dye); (c) a cell-penetrating peptide; (d) an endosomal escape peptide; and (e) an affinity tag. The systems including a tracrRNA as disclosed herein can also be employed with related Cas nucleases, including Csm nucleases, e.g., ObCsm1 (GenBank accession number OGX23684), SmCsm1 (GenBank accession number KF067988), MiCsm1 (GenBank accession number KKQ38176), or SuCsm1 (GenBank accession number KIM12007) (see, e.g., Begemann et al. (2017) bioRxiv, publicly available at dx[dot]doi[dot]org/10[dot]1101/ 192799), nucleases having a sequence selected from the group consisting of SEQ ID NOs:115, 137, 138, and 137, and variants thereof, such as a variant ObCsm1 that differs from a wild-type ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

In embodiments of the fifth engineered system, the at least one engineered Cas12a crRNA includes a spacer sequence designed to hybridize with a target sequence in a eukaryotic cell. Target sequences and eukaryotic cells are described in detail below under the section headed "Related Disclosure". In embodiments of the fifth engineered system, the at least one engineered Cas12a crRNA, or the one or more nucleotide sequences encoding the at least one engineered Cas12a crRNA, further includes at least one direct repeat sequence or fragment thereof that is capable of associating with the Cas12a nuclease and is adjacent to and 5' to the spacer sequence. In embodiments of the fifth engineered system, the engineered Cas12a crRNA, or a polynucleotide encoding the engineered Cas12a crRNA, further includes at least one direct repeat sequence or fragment thereof capable of associating with the Cas12a nuclease, wherein the at least one direct repeat sequence or fragment thereof is adjacent to and 3' to the spacer sequence. In embodiments of the fifth engineered system where the engineered Cas12a crRNA further includes at least one direct repeat sequence or fragment thereof capable of associating with the Cas12a nuclease, wherein the at least one direct repeat sequence or fragment thereof is adjacent to and 3' to the spacer sequence, the Cas12a tracrRNA has a nucleotide sequence that has at least about 50% or preferably greater than 50% complementarity to the at least one direct repeat sequence or fragment adjacent to and 3' to the spacer sequence. In embodiments of the fifth engineered system, the engineered Cas12a crRNA further includes a 3' extension adjacent to the spacer sequence; in some embodiments, the 3' extension includes nucleotides that when base-paired form about one helical turn; in some embodiments, the 3' extension includes at least 10 contiguous nucleotides. In embodiments of the fifth engineered system where the engineered Cas12a crRNA further includes a 3' extension adjacent to the spacer sequence, the Cas12a tracrRNA has a nucleotide sequence having sufficient complementarity (e.g., about 50% or greater than 50%) to the engineered Cas12a crRNA's 3' extension to allow hybridization between the Cas12a tracrRNA and the engineered Cas12a crRNA.

In embodiments of the fifth engineered system, the at least one tracrRNA, or the one or more nucleotide sequences encoding at least one Cas12a tracrRNA, includes a nucleotide sequence that has at least 50% complementarity with, the nucleotide sequence of a direct repeat sequence or fragment thereof that is capable of associating with the Cas12a nuclease and is adjacent to and 5' to the spacer sequence of the engineered Cas12a crRNA. In embodiments of the fifth engineered system, the at least one tracrRNA, or the one or more nucleotide sequences encoding the at least one Cas12a tracrRNA, includes a nucleotide sequence of a naturally occurring putative Cas12a tracrRNA sequence identified from a native Cas12a locus, such as a nucleotide sequence of a naturally occurring putative Cas12a tracrRNA sequence identified from a genome using the techniques described by Zetsche et al. (2015) *Cell,* 163:759-771, and in U.S. Pat. No. 9,790,490. A naturally occurring putative Cas12a tracrRNA sequence can be identified from a genome as DNA sequence encoding a RNA molecule that: is predicted to be or putatively transcribed (or that may be determined to be transcribed, e.g., by RNA analysis) from a Cas12a CRISPR genomic region, specifically from a locus that flanks the DNA encoding the Cas12a CRISPR nuclease; that preferably includes a predicted transcriptional terminator in the direction of transcription; that is about 60 to about 100 nucleotides in length, e.g., 60-80 nucleotides, 60-85 nucleotides, 60-90 nucleotides, or 65-95 nucleotides; and that is not a direct repeat in the Cas12a CRISPR array, but rather has a nucleotide sequence that permits the transcribed tracrRNA to hybridize to the crRNA (i.e., the naturally occurring putative Cas12a tracrRNA sequence has sufficient complementarity to a crRNA sequence to hybridize to the crRNA). In embodiments, the Cas12a tracrRNA locus is directly adjacent to the DNA encoding the Cas12a nuclease. In embodiments, there is additional genomic sequence, such as DNA sequence encoding other Cas nucleases, located between the Cas12a tracrRNA locus and the DNA encoding the Cas12a nuclease; see, e.g., FIGS. 1 and 4. In embodiments of the fifth engineered system, the at least one tracrRNA, or the one or more nucleotide sequences encoding the at least one Cas12a tracrRNA, has a nucleotide sequence having at least 50% identity (e.g., at least 50%, at least 51%, at least 52%, at least 53%, at least 54%, at least 55%, at least 56%, at least 57%, at least 58%, at least 59%, or at least 60% sequence identity) to the sequence of the direct repeat. In embodiments of the fifth engineered system, the at least one tracrRNA, or the one or more nucleotide sequences encoding the at least one Cas12a tracrRNA, has a nucleotide sequence including a sequence selected from the group consisting of SEQ ID NOs:1, 3, 6, 139-146, 149-169, 223-240, and 241. An alternative embodiment of a "Cas12a tracrRNA" includes an RNA molecule having or including a nucleotide sequence based on the nucleotide sequence of a naturally occurring putative Cas12a tracrRNA sequence identified from a native Cas12a locus. Examples include RNA molecules that include the nucleotide sequence of a naturally occurring putative Cas12a tracrRNA sequence identified from a native Cas12a locus but that further include one or more modifications such as (a) additional nucleotides, e.g., an extension at the 3' terminus, (b) insertion, deletion, or substitution of one or more nucleotides within the naturally occurring tracrRNA sequence, preferably maintaining the secondary structure of the tracrRNA, and (c) chemical modifications, e.g., addition of a detectable label. In embodiments of the fifth engineered system, the at least one tracrRNA, or the one or more nucleotide sequences encoding the at least one Cas12a tracrRNA, further includes a 5' extension, such as the 5' extensions disclosed by Park et al. (2018) *Nature Communications,* doi: 10.1038/s41467-018-05641-3.

Another aspect of the invention provides a sixth engineered system including one or more vectors including: (a) a first expression cassette including at least a first promoter that is heterologous to and operably linked to one or more nucleotide sequences encoding a Cas12a nuclease and—optionally—a first transcription terminator sequence; and (b) a second expression cassette including at least a second promoter that is heterologous to operably linked to one or more nucleotide sequences encoding at least one engineered Cas12a crRNA that is designed to form a complex with the Cas12a nuclease and that includes a spacer sequence designed to hybridize with a target sequence in a eukaryotic cell and—optionally—a second transcription terminator sequence; and (c) a third expression cassette including at least a third promoter that is heterologous to operably linked to one or more nucleotide sequences encoding at least one Cas12a tracrRNA and—optionally—a third transcription terminator sequence, wherein components (a) and (b) and (c) are located on the same vector or on different vectors of the system.

In embodiments of the sixth engineered system, the first promoter, the second promoter, and the third promoter are each a promoter that is functional in the eukaryotic cell, and wherein the first transcription terminator, the second transcription terminator, and the third transcription terminator are each a transcription terminator that is functional in the eukaryotic cell. In embodiments, the first promoter, the second promoter, and the third promoter are each a promoter selected from the group consisting of pol III promoters, pol II promoters, and pol I promoters. In embodiments of the sixth engineered system, the first promoter, the second promoter, and the third promoter are each a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, an EF1a promoter. In embodiments of the sixth engineered system, the first promoter, the second promoter, and the third promoter are each a promoter with a nucleotide sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter. In embodiments of the sixth engineered system, the first transcription terminator, the second transcription terminator, and the third transcription terminator are each selected from the group consisting of a U6 poly-T terminator, an SV40 terminator, an hGH terminator, a BGH terminator, an rbGlob terminator, a synthetic terminator functional in a eukaryotic cell, a 3' element from an *Agrobacterium* sp. gene, a 3' element from a non-human animal gene, a 3' element from a human gene, and a 3' element from a plant gene, wherein the 3' element terminate transcription of an RNA transcript located immediately 5' to the 3' element. In embodiments of the sixth engineered system, the first transcription terminator, the second transcription terminator, and the third transcription terminator are each a transcription terminator having a sequence selected from the group consisting of SEQ ID NOs:72-100 or comprise a U6 poly-T terminator, an SV40 terminator, an hGH terminator, a BGH terminator, an rbGlob terminator, or a synthetic terminator functional in a eukaryotic cell.

In embodiments of the sixth engineered system, the Cas12a nuclease is (a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A. In embodiments, the Cas12a nuclease is deactivated. In embodiments, the Cas12a nuclease includes at least one modification selected from the group consisting of: (a) a localization signal (e.g., a nuclear localization signal, a mitochondrial localization signal, or a plastid localization signal); (b) a detectable label (e.g., a fluorescent dye); (c) a cell-penetrating peptide; (d) an endosomal escape peptide; and (e) an affinity tag. The systems including a tracrRNA as disclosed herein can also be employed with related Cas nucleases, including Csm nucleases, e.g., ObCsm1 (GenBank accession number OGX23684), SmCsm1 (GenBank accession number KF067988), MiCsm1 (GenBank accession number KKQ38176), or SuCsm1 (GenBank accession number KIM12007) (see, e.g., Begemann et al. (2017) bioRxiv, publicly available at dx[dot]doi[dot]org/10[dot]1101/192799), nucleases having a sequence selected from the group consisting of SEQ ID NOs:115, 137, 138, and variants thereof, such as a variant ObCsm1 that differs from a wild-type ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

In embodiments of the sixth engineered system, the at least one tracrRNA, or the one or more nucleotide sequences encoding at least one Cas12a tracrRNA, includes a nucleotide sequence that has at least 50% complementarity with, the nucleotide sequence of a direct repeat sequence or fragment thereof that is capable of associating with the Cas12a nuclease and is adjacent to and 5' to the spacer sequence of the engineered Cas12a crRNA. In embodiments of the sixth engineered system, the at least one tracrRNA, or the one or more nucleotide sequences encoding the at least one Cas12a tracrRNA, includes a nucleotide sequence of a naturally occurring putative Cas12a tracrRNA sequence identified from a native Cas12a locus, such as a nucleotide sequence of a naturally occurring putative Cas12a tracrRNA sequence identified from a genome using the techniques described by Zetsche et al. (2015) *Cell*, 163:759-771, and in U.S. Pat. No. 9,790,490. A naturally occurring putative Cas12a tracrRNA sequence can be identified from a genome as DNA sequence encoding a RNA molecule that: is predicted to be or putatively transcribed (or that may be determined to be transcribed, e.g., by RNA analysis) from a Cas12a CRISPR genomic region, specifically from a locus that flanks the DNA encoding the Cas12a CRISPR nuclease; that preferably includes a predicted transcriptional terminator in the direction of transcription; that is about 60 to about 100 nucleotides in length, e.g., 60-80 nucleotides, 60-85 nucleotides, 60-90 nucleotides, or 65-95 nucleotides; and that is not a direct repeat in the Cas12a CRISPR array, but rather has a nucleotide sequence that permits the transcribed tracrRNA to hybridize to the crRNA (i.e., the naturally occurring putative Cas12a tracrRNA sequence has sufficient complementarity to a crRNA sequence to hybridize to the crRNA). In embodiments, the Cas12a tracrRNA locus is directly adjacent to the DNA encoding the Cas12a nuclease. In embodiments, there is additional genomic sequence, such as DNA sequence encoding other Cas nucleases, located between the Cas12a tracrRNA locus and the DNA encoding the Cas12a nuclease; see, e.g., FIGS. 1 and 4. In embodiments of the sixth engineered system, the at least one tracrRNA, or the one or more nucleotide sequences encoding the at least one Cas12a tracrRNA, has a nucleotide sequence having at least 50% identity (e.g., at least 50%, at least 51%, at least 52%, at least 53%, at least 54%, at least 55%, at least 56%, at least 57%, at least 58%, at least 59%, or at least 60% sequence identity) to the sequence of the direct repeat. In embodiments of the sixth engineered system, the at least one tracrRNA, or the one or more nucleotide sequences encoding the at least one Cas12a tracrRNA, has a nucleotide sequence including a sequence selected from the group consisting of SEQ ID NOs:1, 3, 6, 139-146, 149-169, 223-240, and 241. An alternative embodiment of a "Cas12a tracrRNA" includes an RNA molecule having or including a nucleotide sequence based on the nucleotide sequence of a naturally occurring putative Cas12a tracrRNA sequence identified from a native Cas12a locus. Examples include RNA molecules that include the nucleotide sequence of a naturally occurring putative Cas12a tracrRNA sequence identified from a native Cas12a locus but that further include one or more modifications such as (a) additional nucleotides, e.g., an extension at the 3' terminus, (b) insertion, deletion, or substitution of one or more nucleotides within the naturally occurring tracrRNA sequence, preferably maintaining the secondary structure of the tracrRNA, and (c) chemical modifications, e.g., addition of a detectable label. In embodiments of the sixth engineered system, the at least one tracrRNA, or the one or more nucleotide sequences encoding the at least one Cas12a tracrRNA, further includes a 5' extension, such as the 5' extensions disclosed by Park et al. (2018) *Nature Communications*, doi: 10.1038/s41467-018-05641-3.

In embodiments of the sixth engineered system, the at least one engineered Cas12a crRNA includes a spacer sequence designed to hybridize with a target sequence in a eukaryotic cell. Target sequences and eukaryotic cells are described in detail below under the section headed "Related Disclosure". In embodiments, the eukaryotic cell is a non-human animal cell, a human cell, a plant cell, or a fungal cell. In embodiments of the sixth engineered system, the eukaryotic cell is in vitro, ex vivo, or in vivo.

Disclosure Related to the Engineered Systems

The disclosure of this section is related to embodiments of the first, second, third, fourth, fifth, and sixth engineered systems.

In embodiments of any one of the first, second, third, fourth, fifth, and sixth engineered systems, the Cas12a nuclease is: (a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, *Peregrinibacteria bacterium* GW2011_GWA2_33_10, *Parcubacteria bacterium* GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A. In embodiments, the Cas12a nuclease is deactivated. In embodiments, the Cas12a nuclease includes at least one modification selected from the group consisting of: (a) a localization signal (e.g., a nuclear localization signal, a mitochondrial localization signal, or a plastid localization signal); (b) a detectable label (e.g., a fluorescent dye); (c) a cell-penetrating peptide; (d) an endosomal escape peptide; and (e) an affinity tag. The systems including a tracrRNA as disclosed herein can also be employed with related Cas nucleases, including Csm nucleases, e.g., ObCsm1 (GenBank accession number OGX23684), SmCsm1 (GenBank accession number KF067988), MiCsm1 (GenBank accession number KKQ38176), or SuCsm1 (GenBank accession number KIM12007) (see, e.g., Begemann et al. (2017) bioRxiv, publicly available at dx[dot]doi[dot]org/10[dot]1101/192799), nucleases having a sequence selected from the group consisting of SEQ ID NOs:115, 137, 138, and variants thereof, such as a variant ObCsm1 that differs from a wild-type ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

In embodiments of any one of the first, second, third, fourth, fifth, and sixth engineered systems, the at least one Cas12a tracrRNA has a nucleotide sequence selected from the group consisting of SEQ ID NOs:1, 3, 6, 139-146, 149-169, 223-240, and 241. In embodiments of any one of the first, second, third, fourth, fifth, and sixth engineered systems, the genomic sequence encoding the Cas12a nuclease and the genomic sequence encoding the Cas12a tracrRNA occur naturally within the same region in a genome; in embodiments, the genomic sequence encoding the Cas12a tracrRNA is located preferably within about 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, or 2.0 kilobases of the DNA segment(s) encoding the Cas12a nuclease. In embodiments of any one of the first, second, third, fourth, fifth, and sixth engineered systems, the target sequence is located 3' of a Protospacer Adjacent Motif (PAM) and the PAM sequence is TTN, where N is A/C/G or T and the Cas12a nuclease is FnCpf1, or the PAM sequence is TTTV, where V is A/C or G and the Cas12a nuclease is PaCpf1p, LbCpf1 or AsCpf1.

In embodiments of any one of the first, second, fourth, fifth, and sixth engineered systems, the Cas12a tracrRNA is a putative Cas12a tracrRNA that is identified from the same genomic region as the Cas12a nuclease by at least the following steps: (a) identifying in the genomic region flanking the DNA encoding the Cas12a nuclease at least one nucleotide sequence that includes a CRISPR array including direct repeats; (b) identifying as a putative Cas12a tracrRNA at least one nucleotide sequence in either the sense or antisense direction in the genomic region flanking the DNA encoding the Cas12a nuclease, wherein the putative Cas12a tracrRNA has a nucleotide sequence that has at least 50% complementarity with, the nucleotide sequence of the direct repeat. In embodiments, the genomic sequence encoding the Cas12a tracrRNA is located preferably within about 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, or 2.0 kilobases of the DNA segment(s) encoding the Cas12a nuclease. In embodiments, the Cas12a tracrRNA locus is directly adjacent to the DNA encoding the Cas12a nuclease. In embodiments, there is additional genomic sequence, such as DNA sequence encoding other Cas nucleases, located between the Cas12a tracrRNA locus and the DNA encoding the Cas12a nuclease; see, e.g., FIGS. 1 and 4.

In embodiments of any one of the first, second, fourth, fifth, and sixth engineered systems, the Cas12a tracrRNA is provided: (a) as DNA encoding a first RNA molecule including the Cas12a tracrRNA and including a restriction endonuclease cleavage site that is suitable for insertion of a sequence coding for a functional RNA moiety; or (b) as a functional RNA molecule including the Cas12a tracrRNA and a functional RNA moiety, or as a polynucleotide encoding the functional RNA molecule; or (c) by a DNA expression system including: (i) DNA sequence for a first promoter; and (ii) operably linked and heterologous to the first promoter, a DNA sequence encoding a first RNA molecule including a Cas12a tracrRNA and including a restriction endonuclease cleavage site that is suitable for insertion of a sequence coding for a functional RNA moiety; or (d) by a DNA expression system including: (a) DNA sequence for a first promoter; and (b) operably linked and heterologous to the first promoter, a DNA sequence encoding a functional RNA molecule including a Cas12a tracrRNA and a functional RNA moiety. In embodiments, the DNA expression system includes (a) DNA sequence for a first promoter; and (b) operably linked and heterologous to the first promoter, a DNA sequence encoding a functional RNA molecule including a Cas12a tracrRNA and a functional RNA moiety, and (c) a terminator 3' to and operably linked to the DNA encoding a functional RNA molecule.

In embodiments of any one of the first, second, third, fourth, fifth, and sixth engineered systems, the Cas12a tracrRNA is provided as DNA encoding a first RNA molecule including the Cas12a tracrRNA and including a restriction endonuclease cleavage site that is suitable for insertion of a sequence coding for a functional RNA moiety, and wherein the functional RNA moiety is at least one selected from the group consisting of: (a) a nucleotide sequence for annealing to a donor polynucleotide; (b) a nucleotide sequence for annealing to the crRNA 3' extension; (c) a terminator sequence; (d) an RNA aptamer; (e) an enzymatically active RNA sequence; (f) a detectable label; and (g) an RNA sequence forming at least partially double-stranded RNA. In embodiments of any one of the first, second, fourth, fifth, and sixth engineered systems, the Cas12a tracrRNA is provided as DNA encoding a first RNA molecule including the Cas12a tracrRNA and including a restriction endonuclease cleavage site that is suitable for insertion of a sequence coding for a functional RNA moiety, wherein the functional RNA moiety includes RNA forming at least partially double-stranded RNA capable of silencing a gene (e.g., RNA that forms one or more stem-loops where the stem includes double-stranded RNA of at least about 18 base-pairs designed to silence a target gene, or RNA that has the secondary structure of a microRNA precursor and is processed to a mature microRNA designed to silence a target gene). In embodiments of any one of the first, second, fourth, fifth, and sixth engineered systems, the Cas12a tracrRNA is provided as DNA encoding a first RNA molecule including the Cas12a tracrRNA and including a restriction endonuclease cleavage site that is suitable for insertion of a sequence coding for a functional RNA moiety, wherein the functional RNA moiety includes an RNA sequence for annealing to a donor polynucleotide, and wherein the composition further includes the donor polynucleotide.

In embodiments of any one of the first, second, third fourth, fifth, and sixth engineered systems, the Cas12a tracrRNA is provided as a functional RNA molecule including the Cas12a tracrRNA and a functional RNA moiety, or as a polynucleotide encoding the functional RNA molecule, and wherein the functional RNA moiety is at least one selected from the group consisting of: (a) a nucleotide sequence for annealing to a donor polynucleotide; (b) a nucleotide sequence for annealing to the crRNA 3' extension; (c) a terminator sequence; (d) an RNA aptamer; (e) an enzymatically active RNA sequence; (f) a detectable label; and (g) an RNA sequence forming at least partially double-stranded RNA. In embodiments of any one of the first, second, third, fourth, fifth, and sixth engineered systems, the Cas12a tracrRNA is provided as a functional RNA molecule including the Cas12a tracrRNA and a functional RNA moiety, or as a polynucleotide encoding the functional RNA molecule, and wherein the functional RNA moiety includes RNA forming at least partially double-stranded RNA capable of silencing a gene (e.g., RNA that forms one or more stem-loops where the stem includes double-stranded RNA of at least about 18 base-pairs designed to silence a target gene, or RNA that has the secondary structure of a microRNA precursor and is processed to a mature microRNA designed to silence a target gene). In embodiments of any one of the first, second, third, fourth, fifth, and sixth engineered systems, the Cas12a tracrRNA is provided as a functional RNA molecule including the Cas12a tracrRNA and a functional RNA moiety, or as a polynucleotide encoding the functional RNA molecule, and wherein the functional RNA moiety includes RNA forming at least partially double-stranded RNA capable of silencing a gene that is involved in one or more small RNA-mediated silencing pathways, e.g., RDR6, SDE3, RDR2, WEX, SGS3, DCL2-4, UPF1, UPF3, HEN1, NRPDIA, NRPD2, DRD1, HDA6, AGO1, and MOP1.

In embodiments of any one of the first, second, third, fourth, fifth, and sixth engineered systems, the Cas12a tracrRNA is provided as a functional RNA molecule including the Cas12a tracrRNA and a functional RNA moiety, or as a polynucleotide encoding the functional RNA molecule, wherein the functional RNA moiety includes an RNA sequence for annealing to a donor polynucleotide, and wherein the system further includes the donor polynucleotide. In embodiments, the donor polynucleotide is single-stranded DNA, or is blunt-ended double-stranded DNA, or is double-stranded DNA with an overhang at least at one terminus, or is an at least partially double-stranded DNA/RNA hybrid. In embodiments of any one of the first, second, third, fourth, fifth, and sixth engineered systems, the Cas12a tracrRNA is provided in a molar excess, relative to the amount of Cas12a nuclease. In embodiments of any one of the first, second, third, fourth, fifth, and sixth engineered systems, the Cas12a tracrRNA is provided in a molar amount that is at least 10-fold greater than the molar amount of the Cas12a nuclease.

A related aspect of the invention includes a delivery particle including the engineered system any one of the first, second, third, fourth, fifth, and sixth engineered systems. In embodiments of the delivery particle, the Cas12a nuclease is complexed with the engineered Cas12a crRNA polynucleotide, e.g., to form a Cas12a ribonucleoprotein. In embodiments of the delivery particle, the Cas12a tracrRNA is present in a molar excess, relative to the amount of Cas12a nuclease (or Cas12a ribonucleoprotein). In embodiments of the delivery particle, the Cas12a tracrRNA is present in a molar amount that is at least 10-fold greater than the molar amount of the Cas12a nuclease (or Cas12a ribonucleoprotein). In embodiments of the delivery particle, the Cas12a nuclease is first complexed with the engineered Cas12a crRNA polynucleotide, e.g., to form a Cas12a ribonucleoprotein, followed by provision, without an annealing step, of the Cas12a tracrRNA in a molar amount that is at least 10-fold greater than the molar amount of the Cas12a nuclease (or Cas12a ribonucleoprotein).

A related aspect of the invention includes a delivery liquid including the engineered system any one of the first, second, third, fourth, fifth, and sixth engineered systems. In embodiments of the delivery liquid, the Cas12a nuclease is complexed with the engineered Cas12a crRNA polynucleotide, e.g., to form a Cas12a ribonucleoprotein. In embodiments of the delivery liquid, the Cas12a tracrRNA is present in a molar excess, relative to the amount of Cas12a nuclease (or Cas12a ribonucleoprotein). In embodiments of the delivery liquid, wherein the Cas12a tracrRNA is present in a molar amount that is at least 10-fold greater than the molar amount of the Cas12a nuclease (or Cas12a ribonucleoprotein). In embodiments of the delivery liquid, the Cas12a nuclease is first complexed with the engineered Cas12a crRNA polynucleotide, e.g., to form a Cas12a ribonucleoprotein, followed by provision, without an annealing step, of the Cas12a tracrRNA in a molar amount that is at least 10-fold greater than the molar amount of the Cas12a nuclease (or Cas12a ribonucleoprotein).

Yet another aspect of the invention includes a method of modifying or editing a target sequence in a locus of interest of a eukaryotic cell including delivering the engineered system according to any one of the first, second, third, fourth, fifth, and sixth engineered systems to the locus of interest, wherein the spacer sequence hybridizes with the target sequence, whereby modification or editing of the locus of interest occurs. Target sequences and eukaryotic cells are described in detail below under the section headed "Related Disclosure". The locus of interest is any specific locus in a DNA molecule, chromosome, or genome obtained from or located within a eukaryotic cell, a eukaryotic tissue, or a eukaryotic organism; in embodiments, the DNA molecule, chromosome, or genome is in vitro, ex vivo, or in vivo. In embodiments of the method, the eukaryotic cell includes a cell of a cell line or a cell of a multicellular organism, and the locus of interest includes a locus of interest in the genome of the eukaryotic cell. In embodiments of the method, the locus of interest is DNA encoding a gene of interest, and can include coding sequence, non-coding sequence, or both coding and non-coding sequence, and can include an intact functional gene (e.g., including untranscribed regions located 3' or 5' to DNA regions encoding a polypeptide, introns, and regulatory elements such as promoters, enhancers, polyadenylation signals, and terminators). In embodiments of the method, the target sequence is a segment of the locus of interest; in embodiments, the target sequence includes about 20 to about 30 contiguous nucleotides and has near perfect or perfect sequence complementarity to the nucleotide sequence of the spacer of the Cas12a crRNA. In embodiments of the method, the eukaryotic cell is a non-human animal cell, a human cell, a plant cell, or a fungal cell. In embodiments of the method, the eukaryotic cell is in vitro, ex vivo, or in vivo. In embodiments of the method, the locus of interest is within a eukaryotic cell, a eukaryotic tissue, or a eukaryotic organism; in embodiments, the locus of interest is within the genome of a non-human animal, a human, a plant, or a fungus, or within the genome of a eukaryotic organelle such as a mitochondrion or a plastid (e.g., a chloroplast). In embodiments of the method, the eukaryotic cell includes a non-human animal or human stem cell or a non-human animal or human stem cell line. In embodiments of the method, the locus of interest is within a eukaryotic DNA molecule in vitro or in a recombinant DNA molecule or recombinant vector.

In embodiments of the method, the eukaryotic cell includes a plant cell, and the modification of the locus of interest is correlated with a modified trait in a plant including cells containing the modification of the locus of interest. In embodiments of the method, the eukaryotic cell includes a plant cell, the modification of the locus of interest is correlated with a modified trait in a plant including cells containing the modification of the locus of interest, and the method further includes obtaining, growing, or regenerating a plant from the plant cell, wherein the plant includes cells containing the modification of the locus of interest, and wherein the plant exhibits the modified trait effected by the modification of the locus of interest. In embodiments of the method, the eukaryotic cell includes a plant cell, and the method further includes identifying a trait of interest in a plant obtained, grown, or regenerated from the plant cell, wherein the trait of interest is effected by the modification of the locus of interest. In embodiments of the method, the eukaryotic cell includes a plant cell, the method further includes identifying a trait of interest in a plant obtained, grown, or regenerated from the plant cell, wherein the trait of interest is effected by the modification of the locus of interest, and the method further includes (a) introducing a nucleotide sequence including the locus of interest into a plant cell, a plant cell line, or a plant germplasm, and generating from the plant cell, the plant cell line, or the plant germplasm a plant including cells containing the nucleotide sequence including the locus of interest; or (b) introducing the modified locus of interest into a plant cell, a plant cell line, or a plant germplasm, and generating from the plant cell, the plant cell line, or the plant germplasm a plant including cells containing the modified locus of interest; or (c) modifying expression of the locus of interest in a plant cell, a plant cell line, or a plant germplasm, and generating from the plant cell, the plant cell line, or the plant germplasm a plant including cells containing the locus of interest having modified expression; or (d) deleting the locus of interest or an endogenous nucleotide sequence including the locus of interest in a plant cell, and generating from the plant cell, the plant cell line, or the plant germplasm a plant including cells in which the locus of interest or the endogenous nucleotide sequence including the locus of interest has been deleted.

In embodiments of the method, the eukaryotic cell includes a non-human animal cell (e.g. a somatic cell or gamete of a non-human animal, in vivo, in vitro, or ex vivo), and the modification of the locus of interest is correlated with a modified trait or characteristic in a non-human animal including cells containing the modification of the locus of interest. In embodiments of the method, the eukaryotic cell includes a non-human animal cell, the modification of the locus of interest is correlated with a modified trait or characteristic in a non-human animal or in a non-human animal cell line including cells containing the modification of the locus of interest, and the method further includes obtaining, growing, regenerating, or breeding a non-human animal or a non-human animal cell line from the non-human animal cell, wherein the non-human animal or a non-human animal cell line includes cells containing the modification of the locus of interest, and wherein the non-human animal or a non-human animal cell line exhibits the modified trait or characteristic effected by the modification of the locus of interest. In embodiments of the method, the eukaryotic cell includes a non-human animal cell, and the method further includes identifying a trait or characteristic of interest in a non-human animal or a non-human animal cell line obtained, grown, regenerated, or bred from the non-human animal cell, wherein the trait or characteristic of interest is effected by the modification of the locus of interest. In embodiments of the method, the eukaryotic cell includes a non-human animal cell, the method further includes identifying a trait or characteristic of interest in a non-human animal or a non-human animal cell line obtained, grown, regenerated, or bred from the non-human animal cell, wherein the trait or characteristic of interest is effected by the modification of the locus of interest, and the method further includes (a) introducing a nucleotide sequence including the locus of interest into a non-human animal cell, a non-human animal cell line, or a non-human animal, and obtaining, growing, regenerating, or breeding from the non-human animal cell, the non-human animal cell line, or the non-human animal a non-human animal or a non-human animal cell line including cells containing the nucleotide sequence including the locus of interest; or (b) introducing the modified locus of interest into a non-human animal cell, a non-human animal cell line, or a non-human animal, and obtaining, growing, regenerating, or breeding from the non-human animal cell, the non-human animal cell line, or the non-human animal a non-human animal or a non-human animal cell line including cells containing the modified locus of interest; or (c) modifying expression of the locus of interest in a non-human animal cell, a non-human animal cell line, or a non-human animal, and obtaining, growing, regenerating, or breeding from the non-human animal cell, the non-human animal cell line, or the non-human animal a non-human animal or a non-human animal cell line including cells containing the locus of interest having modified expression; or (d) deleting the locus of interest or an endogenous nucleotide sequence including the locus of interest in a non-human animal cell, a non-human animal cell line, or a non-human animal, and obtaining, growing, regenerating, or breeding from the non-human animal cell, the non-human animal cell line, or the non-human animal a non-human animal or a non-human animal cell line including cells in which the locus of interest or the endogenous nucleotide sequence including the locus of interest has been deleted.

In embodiments of the method, the engineered system or a component thereof is delivered via delivery particles, delivery vesicles, delivery liquids, or one or more viral or bacterial vectors. In embodiments of the method, the engineered system or a component thereof is delivered via delivery particles such as delivery nanoparticles or delivery microparticles including at least one material or reagent selected from the group consisting of a lipid, a sugar, a metal, or a protein. In embodiments of the method, the system or a component thereof is delivered via delivery exosomes or liposomes. In embodiments of the method, the engineered system or a component thereof is delivered via at least one viral vector selected from the group consisting of adenoviruses, lentiviruses, adeno-associated viruses, retroviruses, geminiviruses, begomoviruses, tobamoviruses, potex viruses, comoviruses, wheat streak mosaic virus, barley stripe mosaic virus, bean yellow dwarf virus, bean pod mottle virus, cabbage leaf curl virus, beet curly top virus, tobacco yellow dwarf virus, tobacco rattle virus, potato virus X, and cowpea mosaic virus. In embodiments of the method, the engineered system or a component thereof is delivered via at least one bacterial vector capable of transforming a plant cell and selected from the group consisting of *Agrobacterium* sp., *Rhizobium* sp., *Sinorhizobium* (Ensifer) sp., *Mesorhizobium* sp., *Bradyrhizobium* sp., *Azobacter* sp., and *Phyllobacterium* sp. Additional information on delivery particles, delivery vesicles, delivery liquids, viral or bacterial vectors, and reagents and methods for their use is found in the section below headed "Delivery Methods and Delivery Agents".

In embodiments of the method, the Cas12a nuclease is: (a) a Cas12a nuclease identified from the genome of a bacterial species selected from the group consisting of *Francisella tularensis* 1, *Prevotella albensis, Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, *Candidatus Methanoplasma termitum, Eubacterium eligens, Moraxella bovoculi* 237, *Leptospira inadai, Lachnospiraceae bacterium* ND2006, *Porphyromonas crevioricanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A. In embodiments, the Cas12a nuclease is deactivated. In embodiments, the Cas12a nuclease includes at least one modification selected from the group consisting of: (a) a localization signal (e.g., a nuclear localization signal, a mitochondrial localization signal, or a plastid localization signal); (b) a detectable label (e.g., a fluorescent dye); (c) a cell-penetrating peptide; (d) an endosomal escape peptide; and (e) an affinity tag.

In embodiments of the method, the Cas12a tracrRNA has a nucleotide sequence including a sequence selected from the group consisting of SEQ ID NOs:1, 3, 6, 139-146, 149-169, 223-240, and 241. In embodiments of the method, the tracrRNA is a putative Cas12a tracrRNA that is identified from the same genomic region as the Cas12a nuclease by at least the following steps: (a) identifying in the genomic region flanking the DNA encoding the Cas12a nuclease at least one nucleotide sequence that includes a CRISPR array including direct repeats; (b) identifying as a putative Cas12a tracrRNA at least one nucleotide sequence in either the sense or antisense direction in the genomic region flanking the DNA encoding the Cas12a nuclease, wherein the putative Cas12a tracrRNA has a nucleotide sequence that has at least 50% complementarity with, the nucleotide sequence of the direct repeat. In embodiments of the method, the Cas12a tracrRNA locus is directly adjacent to the DNA encoding the Cas12a nuclease. In embodiments of the method, there is additional genomic sequence, such as DNA sequence encoding other Cas nucleases, located between the Cas12a tracrRNA locus and the DNA encoding the Cas12a nuclease; see, e.g., FIGS. 1 and 4.

Methods of Editing a Genetic Locus with a Cas12a Nuclease with Increased Efficiency A further aspect of the invention includes a method of editing a genetic locus with a Cas12a nuclease, including contacting DNA that includes the genetic locus with: (a) a Cas12a nuclease; and (b) an engineered Cas12a crRNA that includes a spacer sequence that is designed to hybridize with a target sequence in the genetic locus; and (c) a Cas12a tracrRNA, thereby editing the genetic locus; wherein the efficiency of editing of the genetic locus is increased compared to a control method in which the DNA that includes the genetic locus is contacted with the Cas12a nuclease and the Cas12a crRNA, but not the Cas12a tracrRNA. The method enables editing a genetic locus or target sequence with a Cas12a nuclease with increased efficiency, in comparison to methods previously reported that employ a Cas12a nuclease and a Cas12a crRNA (or "guide RNA") but do not include a Cas12a tracrRNA. Efficiency of editing is increased, e.g., when the percentage of cells containing the expected edit at the genetic locus is increased compared to that seen in a control, or when a given level of editing is obtained using a lower amount of Cas12a nuclease, compared to a control. A related aspect is a method of increasing the efficiency of editing a genetic locus by a Cas12a ribonucleoprotein that includes a Cas12a nuclease and a Cas12a crRNA, by providing together with the Cas12a ribonucleoprotein a Cas12a tracrRNA that is capable of hybridizing to the Cas12a crRNA (e.g., a Cas12a tracrRNA of between about 60 to about 100 nucleotides in length that has at least 50% complementarity to the sequence of the Cas12a crRNA), whereby the efficiency of the editing of the genetic locus is increased, compared to that obtained in a control method where the Cas12a ribonucleoprotein is provided without the Cas12a tracrRNA; in embodiments of the method, the Cas12a tracrRNA is provided in molar excess of the Cas12a ribonucleoprotein.

In embodiments of the methods, the Cas12a nuclease and the engineered Cas12a crRNA are provided as a ribonucleoprotein complex. In embodiments, the Cas12a nuclease is provided as a polynucleotide encoding the Cas12a nuclease. In embodiments, the Cas12a nuclease is: (a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, Candidatus Methanoplasma termitum, *Eubacterium eligens*, *Moraxella bovoculi* 237, *Leptospira inadai*, *Lachnospiraceae bacterium* ND2006, *Porphyromonas creviorica-nis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, 1994L, T1006K, 11014V, V1055N/D, L1065F/Y, Y1180F, V1209G, 11229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A. In embodiments, the Cas12a nuclease is deactivated. In embodiments, the Cas12a nuclease includes at least one modification selected from the group consisting of: (a) a localization signal (e.g., a nuclear localization signal, a mitochondrial localization signal, or a plastid localization signal); (b) a detectable label (e.g., a fluorescent dye); (c) a cell-penetrating peptide; (d) an endosomal escape peptide; and (e) an affinity tag. The methods including use of a tracrRNA as disclosed herein can also be employed with related Cas nucleases, including Csm nucleases, e.g., ObCsm1 (GenBank accession number OGX23684), SmCsm1 (GenBank accession number KF067988), MiCsm1 (GenBank accession number KKQ38176), or SuCsm1 (GenBank accession number KIM12007) (see, e.g., Begemann et al. (2017) bioRxiv, publicly available at dx[dot]doi[dot]org/10[dot]1101/ 192799), nucleases having a sequence selected from the group consisting of SEQ ID NOs:115, 137, 138, and variants thereof, such as a variant ObCsm1 that differs from a wild-type ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

In embodiments of the methods, the Cas12a tracrRNA is provided: (a) as DNA encoding a first RNA molecule including the Cas12a tracrRNA and including a restriction endonuclease cleavage site that is suitable for insertion of a sequence coding for a functional RNA moiety; or (b) as a functional RNA molecule including the Cas12a tracrRNA and a functional RNA moiety, or as a polynucleotide encoding the functional RNA molecule; or (c) by a DNA expression system comprising (i) DNA sequence for a first promoter; and (ii) operably linked and heterologous to the first promoter, DNA encoding a first RNA molecule comprising a Cas12a tracrRNA and comprising a restriction endonuclease cleavage site that is suitable for insertion of a sequence coding for a functional RNA moiety; and (iii) optionally, a terminator 3' to and operably linked to the DNA encoding the first RNA molecule; or (d) by a DNA expression system comprising: (i) DNA sequence for a first promoter; and (ii) operably linked and heterologous to the first promoter, a DNA encoding a functional RNA molecule comprising a Cas12a tracrRNA and a functional RNA moiety; and (iii) optionally, a terminator 3' to and operably linked to the DNA encoding a functional RNA molecule. In embodiments of the methods, the Cas12a tracrRNA is provided as a synthetic Cas12a tracrRNA, e.g., a Cas12a tracrRNA synthesized in vitro from an expression construct including a heterologous promoter operably linked to DNA encoding the Cas12a tracrRNA and optionally including an operably linked terminator. In embodiments of the methods, the Cas12a tracrRNA is provided as a Cas12a tracrRNA obtained from a naturally occurring source, e.g., isolated from a Cas12a tracrRNA that naturally occurs in genomic DNA, or amplified from a Cas12a tracrRNA that naturally occurs in genomic DNA.

In embodiments of the methods, the Cas12a tracrRNA is a putative tracrRNA. In embodiments, the putative Cas12a tracrRNA is identified from the same genomic region as the Cas12a nuclease by at least the following steps: (a) identifying in the genomic region flanking the DNA encoding the Cas12a nuclease at least one nucleotide sequence that includes a CRISPR array including direct repeats; (b) identifying as a putative Cas12a tracrRNA at least one nucleotide sequence in either the sense or antisense direction in the genomic region flanking the DNA encoding the Cas12a nuclease, wherein the putative Cas12a tracrRNA has a nucleotide sequence that has at least 50% complementarity with, the nucleotide sequence of the direct repeat. In embodiments, the Cas12a tracrRNA locus is directly adjacent to the DNA encoding the Cas12a nuclease. In embodiments, there is additional genomic sequence, such as DNA sequence encoding other Cas nucleases, located between the Cas12a tracrRNA locus and the DNA encoding the Cas12a nuclease; see, e.g., FIGS. 1 and 4.

In embodiments of the methods, the Cas12a tracrRNA is provided in a molar excess, relative to the Cas12a nuclease. In embodiments, the Cas12a tracrRNA is provided in a molar amount that is at least 10-fold (e.g., at least 10-fold, 15-fold, 20-fold, 30-fold, 50-fold, 90-fold, 100-fold, 150-fold, or 200-fold) greater than the molar amount of the Cas12a nuclease. In embodiments, the Cas12a tracrRNA is added in a molar excess (relative to the Cas12a nuclease) to a composition containing the Cas12a ribonucleoprotein including the Cas12a nuclease and the Cas12a crRNA. In embodiments, the Cas12a tracrRNA has a nucleotide sequence comprising a sequence selected from the group consisting of SEQ ID NOs:1, 3, 6, 139-146, 149-169, 223-240, and 241.

In embodiments of the methods, the engineered Cas12a crRNA includes a spacer sequence that is designed to hybridize with a target sequence in the genetic locus. In embodiments, the target sequence is a segment of a genetic locus or a gene of interest. In embodiments, the target sequence includes about 20 to about 30 contiguous nucleotides and has near perfect or perfect sequence complementarity to the nucleotide sequence of the spacer of the Cas12a crRNA. In embodiments, the engineered Cas12a crRNA, or a polynucleotide encoding the engineered Cas12a crRNA, further includes at least one direct repeat sequence or fragment thereof capable of associating with the Cas12a nuclease, wherein the at least one direct repeat sequence or fragment thereof is adjacent to and 3' to the spacer sequence. In embodiments, the engineered Cas12a crRNA further includes a 3' extension adjacent to the spacer sequence. In embodiments, the 3' extension includes nucleotides that when base-paired form about one helical turn. In embodiments, the 3' extension includes at least 10 contiguous nucleotides. In embodiments, the Cas12a tracrRNA has a nucleotide sequence having sufficient complementarity to the engineered Cas12a crRNA's 3' extension to allow hybridization between the tracrRNA and the engineered Cas12a crRNA.

In embodiments of the methods, the editing of the genetic locus is effecting an indel in the genetic locus. In embodiments, the editing of the genetic locus is effecting non-homologous end joining (NHEJ) in the genetic locus. In embodiments, the editing of the genetic locus is effecting homology-dependent repair (HDR) in the genetic locus; in such embodiments, the method can further comprise providing a donor polynucleotide encoding a sequence to be integrated at a double-stranded break that is effected by the method in the genetic locus; examples of suitable donor polynucleotides are described above under the heading "A Method of Integrating a Sequence Encoded by a Donor Polynucleotide at a Specific Locus".

In embodiments of the methods, the DNA that includes the genetic locus is genomic DNA. In embodiments, the genetic locus is genomic DNA of a eukaryotic nucleus, or mitochondrial DNA, or plastid DNA. In embodiments, the DNA that includes the genetic locus is in a eukaryotic DNA molecule in vitro. In embodiments, the DNA that includes the genetic locus is in a eukaryotic cell; in embodiments, the eukaryotic cell is an isolated eukaryotic cell, or a eukaryotic cell in culture, or a eukaryotic cell located in a tissue or organ of a eukaryotic organism. In embodiments, the eukaryotic cell is a cell of a non-human animal, an invertebrate, a vertebrate, a mollusk, an arthropod, an insect, a fish, a reptile, an amphibian, a bird, a mammal, a primate, a non-human primate, a human, a plant, or a fungus. In embodiments, the eukaryotic cell includes a cell of a cell line or a cell of a multicellular organism, and wherein the genetic locus to be modified includes a locus of interest in the genome of the eukaryotic cell. In embodiments, the eukaryotic cell is in vitro, ex vivo, or in vivo. In embodiments, the eukaryotic cell includes a non-human animal or human stem cell or a non-human animal or human stem cell line. Target sequences and eukaryotic cells are described in detail below under the section headed "Related Disclosure".

Compositions for Modifying a Genetic Locus

Yet another aspect of the invention provides a composition for modifying a genetic locus in a eukaryotic cell, including: (a) a eukaryotic cell containing a genetic locus to be modified; and (b) a Cas12a nuclease, or a polynucleotide encoding the Cas12a nuclease; and (c) an engineered Cas12a crRNA that includes a spacer sequence that is designed to hybridize with a target sequence in the genetic locus, or a polynucleotide encoding the Cas12a crRNA; and (d) a Cas12a tracrRNA, or a polynucleotide encoding the Cas12a tracrRNA, wherein the Cas12a tracrRNA is provided in molar excess relative to the Cas12a nuclease. In embodiments wherein the genetic locus is to be modified by homology-dependent repair, the composition further includes: (e) a donor polynucleotide encoding a sequence to be integrated at a double-stranded break in the genetic locus; examples of suitable donor polynucleotides are described above under the heading "A Method of Integrating a Sequence Encoded by a Donor Polynucleotide at a Specific Locus".

In embodiments of the composition, the Cas12a tracrRNA is identified from the same genomic region as the Cas12a nuclease by at least the following steps: (a) identifying in the genomic region flanking the DNA encoding the Cas12a nuclease at least one nucleotide sequence that includes a CRISPR array including direct repeats; (b) identifying as a putative Cas12a tracrRNA at least one nucleotide sequence in either the sense or antisense direction in the genomic region flanking the DNA encoding the Cas12a nuclease, wherein the putative Cas12a tracrRNA has a nucleotide sequence that has at least 50% complementarity with, the nucleotide sequence of the direct repeat. In embodiments, the Cas12a tracrRNA locus is directly adjacent to the DNA encoding the Cas12a nuclease. In embodiments, there is additional genomic sequence, such as DNA sequence encoding other Cas nucleases, located between the Cas12a tracrRNA locus and the DNA encoding the Cas12a nuclease; see, e.g., FIGS. 1 and 4.

In embodiments of the composition, the Cas12a tracrRNA is present in a molar excess, relative to the Cas12a nuclease. In embodiments, the Cas12a tracrRNA is present in a molar amount that is at least 10-fold (e.g., at least 10-fold, 15-fold, 20-fold, 30-fold, 50-fold, 90-fold, 100-fold, 150-fold, or 200-fold) greater than the molar amount of the Cas12a nuclease.

In embodiments of the composition, the eukaryotic cell is a cell of a non-human animal, an invertebrate, a vertebrate, a mollusk, an arthropod, an insect, a fish, a reptile, an amphibian, a bird, a mammal, a primate, a non-human primate, a human, a plant, or a fungus. In embodiments, the eukaryotic cell includes a cell of a cell line or a cell of a multicellular organism, and wherein the genetic locus to be modified includes a locus of interest in the genome of the eukaryotic cell. In embodiments, the eukaryotic cell is in vitro, ex vivo, or in vivo. In embodiments, the eukaryotic cell includes a non-human animal or human stem cell or a non-human animal or human stem cell line.

In embodiments of the composition, the Cas12a nuclease and the engineered Cas12a crRNA are provided as a ribonucleoprotein complex. In embodiments, the Cas12a nuclease is provided as a polynucleotide encoding the Cas12a nuclease. In embodiments, the Cas12a nuclease is: (a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A. In embodiments, the Cas12a nuclease is deactivated. In embodiments, the Cas12a nuclease includes at least one modification selected from the group consisting of: (a) a localization signal (e.g., a nuclear localization signal, a mitochondrial localization signal, or a plastid localization signal); (b) a detectable label (e.g., a fluorescent dye); (c) a cell-penetrating peptide; (d) an endosomal escape peptide; and (e) an affinity tag. The compositions including a tracrRNA as disclosed herein can also be employed with related Cas nucleases, including Csm nucleases, e.g., ObCsm1 (GenBank accession number OGX23684), SmCsm1 (GenBank accession number KF067988), MiCsm1 (GenBank accession number KKQ38176), or SuCsm1 (GenBank accession number KIM12007) (see, e.g., Begemann et al. (2017) bioRxiv, publicly available at dx[dot]doi[dot]org/10[dot]1101/192799), nucleases having a sequence selected from the group consisting of SEQ ID NOs:115, 137, 138, and variants thereof, such as a variant ObCsm1 that differs from a wild-type ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

In embodiments of the composition, the engineered Cas12a crRNA includes a spacer sequence that is designed to hybridize with a target sequence in the genetic locus. In embodiments, the target sequence is a segment of a genetic locus or a gene of interest; in embodiments, the target sequence includes about 20 to about 30 contiguous nucleotides and has near perfect or perfect sequence complementarity to the nucleotide sequence of the spacer of the Cas12a crRNA. In embodiments, the engineered Cas12a crRNA, or a polynucleotide encoding the engineered Cas12a crRNA, further includes at least one direct repeat sequence or fragment thereof capable of associating with the Cas12a nuclease, wherein the at least one direct repeat sequence or fragment thereof is adjacent to and 3' to the spacer sequence. In embodiments, the engineered Cas12a crRNA further includes a 3' extension adjacent to the spacer sequence. In embodiments, the 3' extension includes nucleotides that when base-paired form about one helical turn. In embodiments, the 3' extension includes at least 10 contiguous nucleotides. In embodiments, the Cas12a tracrRNA has a nucleotide sequence having sufficient complementarity to the engineered Cas12a crRNA's 3' extension to allow hybridization between the tracrRNA and the engineered Cas12a crRNA.

In embodiments of the composition, the Cas12a tracrRNA is provided: (a) as DNA encoding a first RNA molecule including the Cas12a tracrRNA and including a restriction endonuclease cleavage site that is suitable for insertion of a sequence coding for a functional RNA moiety; or (b) as a functional RNA molecule including the Cas12a tracrRNA and a functional RNA moiety, or as a polynucleotide encoding the functional RNA molecule; or (c) by a DNA expression system comprising (i) DNA sequence for a first promoter; and (ii) operably linked and heterologous to the first promoter, DNA encoding a first RNA molecule comprising a Cas12a tracrRNA and comprising a restriction endonuclease cleavage site that is suitable for insertion of a sequence coding for a functional RNA moiety; and (iii) optionally, a terminator 3' to and operably linked to the DNA encoding the first RNA molecule; or (d) by a DNA expression system comprising: (i) DNA sequence for a first promoter; and (ii) operably linked and heterologous to the first promoter, a DNA encoding a functional RNA molecule comprising a Cas12a tracrRNA and a functional RNA moiety; and (iii) optionally, a terminator 3' to and operably linked to the DNA encoding a functional RNA molecule.

In embodiments of the composition, the Cas12a tracrRNA is provided as DNA encoding a first RNA molecule including the Cas12a tracrRNA and including a restriction endonuclease cleavage site that is suitable for insertion of a sequence coding for a functional RNA moiety, and wherein the functional RNA moiety is at least one selected from the group consisting of: (a) a nucleotide sequence for annealing to a donor polynucleotide; (b) a nucleotide sequence for annealing to the crRNA 3' extension; (c) a terminator sequence; (d) an RNA aptamer; (e) an enzymatically active RNA sequence; (f) a detectable label; and (g) an RNA sequence forming at least partially double-stranded RNA. In embodiments of the composition, the Cas12a tracrRNA is provided as DNA encoding a first RNA molecule including the Cas12a tracrRNA and including a restriction endonuclease cleavage site that is suitable for insertion of a sequence coding for a functional RNA moiety, wherein the functional RNA moiety includes RNA forming at least partially double-stranded RNA capable of silencing a gene (e.g., RNA that forms one or more stem-loops where the stem includes double-stranded RNA of at least about 18 base-pairs designed to silence a target gene, or RNA that has the secondary structure of a microRNA precursor and is processed to a mature microRNA designed to silence a target gene). In embodiments of the composition, the Cas12a tracrRNA is provided as DNA encoding a first RNA molecule including the Cas12a tracrRNA and including a restriction endonuclease cleavage site that is suitable for insertion of a sequence coding for a functional RNA moiety, wherein the functional RNA moiety includes an RNA sequence for annealing to a donor polynucleotide, and wherein the composition further includes the donor polynucleotide. In embodiments of the composition, the Cas12a tracrRNA is provided as a functional RNA molecule including the Cas12a tracrRNA and a functional RNA moiety, or as a polynucleotide encoding the functional RNA molecule, and wherein the functional RNA moiety is at least one selected from the group consisting of: (a) a nucleotide sequence for annealing to a donor polynucleotide; (b) a nucleotide sequence for annealing to the crRNA 3' extension; (c) a terminator sequence; (d) an RNA aptamer; (e) an enzymatically active RNA sequence; (f) a detectable label; and (g) an RNA sequence forming at least partially double-stranded RNA. In embodiments of the composition, the Cas12a tracrRNA is provided as a functional RNA molecule including the Cas12a tracrRNA and a functional RNA moiety, or as a polynucleotide encoding the functional RNA molecule, and wherein the functional RNA moiety includes RNA forming at least partially double-stranded RNA capable of silencing a gene (e.g., RNA that forms one or more stem-loops where the stem includes double-stranded RNA of at least about 18 base-pairs designed to silence a target gene, or RNA that has the secondary structure of a microRNA precursor and is processed to a mature microRNA designed to silence a target gene). In embodiments of the composition, the Cas12a tracrRNA is provided as a functional RNA molecule including the Cas12a tracrRNA and a functional RNA moiety, or as a polynucleotide encoding the functional RNA molecule, wherein the functional RNA moiety includes an RNA sequence for annealing to a donor polynucleotide, and wherein the composition further includes the donor polynucleotide.

In embodiments of the composition, the genetic locus in a eukaryotic cell to be modified is genomic DNA. In embodiments, the genetic locus is in genomic DNA of a eukaryotic nucleus, or mitochondrial DNA, or plastid DNA. In embodiments, the genetic locus is in a eukaryotic DNA molecule in vitro. In embodiments, the genetic locus is in a eukaryotic cell; in embodiments, the eukaryotic cell is an isolated eukaryotic cell, or a eukaryotic cell in culture, or a eukaryotic cell located in a tissue or organ of a eukaryotic organism. In embodiments, the eukaryotic cell is a cell of a non-human animal, an invertebrate, a vertebrate, a mollusk, an arthropod, an insect, a fish, a reptile, an amphibian, a bird, a mammal, a primate, a non-human primate, a human, a plant, or a fungus. In embodiments, the eukaryotic cell includes a cell of a cell line or a cell of a multicellular organism, and wherein the genetic locus to be modified includes a locus of interest in the genome of the eukaryotic cell. In embodiments, the eukaryotic cell is in vitro, ex vivo, or in vivo. In embodiments, the eukaryotic cell includes a non-human animal or human stem cell or a non-human animal or human stem cell line. Target sequences and eukaryotic cells are described in detail below under the section headed "Related Disclosure."

In certain embodiments, the compositions disclosed herein further comprise one or more pharmaceutically acceptable excipients. Pharmaceutically acceptable excipients include those that serve as a vehicle or medium for the compositions described herein (e.g., any one of the inactive ingredients approved by the United States Food and Drug Administration (FDA) and listed in the Inactive Ingredient Database). Compositions of the present disclosure include compositions which are sterile and/or pyrogen-free. General considerations in the formulation and/or manufacture of pharmaceutical agents include those described in Remington: The Science and Practice of Pharmacy 21st ed., Lippincott Williams & Wilkins, 2005 (incorporated herein by reference). Non-limiting examples of pharmaceutically acceptable excipients include solvents, aqueous solvents, non-aqueous solvents, dispersion media, diluents, dispersions, suspension aids, surface active agents, isotonic agents, thickening agents, emulsifying agents, preservatives, polymers, peptides, proteins, cells, hyaluronidases, dispersing agents, granulating agents, disintegrating agents, binding agents, buffering agents (e.g., phosphate buffered saline (PBS)), lubricating agents, oils, and mixtures thereof. In certain embodiments, compositions disclosed herein for use in a treatments or manufacture of a medicament are suitable for administration to humans or any other animal (e.g., to non-human animals or non-human mammals). Subjects suitable for use of the compositions include humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

Also provided herein are methods of making compositions and methods of using such compositions to treat a genetic disease, cancer, a viral infection, a bacterial infection, a parasitic infection, a fungal infection, or a protozoan infection. In some embodiments, the genetic editing is of a genetic locus involved in a genetic condition or disease. In some embodiments, the disease or disorder is caused by a mutation in an enzyme. In some embodiments, the genetic condition is a metabolic disorder.

Exemplary diseases and target genes (e.g., loci of interest) include Amyloid neuropathy (TTR, PALB); Amyloidosis (APOA1, APP, AAA, CVAP, AD1, GSN, FGA, LYZ, TTR, PALB); Cirrhosis (KRT18, KRT8, CIRH1A, NAIC, TEX292, KIAA1988); Cystic fibrosis (CFTR, ABCC7, CF, MRP7); Glycogen storage diseases (SLC2A2, GLUT2, G6PC, G6PT, G6PT1, GAA, LAMP2, LAMPB, AGL, GDE, GBE1, GYS2, PYGL, PFKM); Hepatic adenoma, 142330 (TCF1, HNF1A, MODY3), Hepatic failure, early onset, and neurologic disorder (SCOD1, SCO1), Hepatic lipase deficiency (LIPC), Hepatoblastoma, cancer and carcinomas (CTNNB1, PDGFRL, PDGRL, PRLTS, AXIN1, AXIN, CTNNB1, TP53, P53, LFS1, IGF2R, MPRI, MET, CASP8, MCH5; Medullary cystic kidney disease (UMOD, HNFJ, FJHN, MCKD2, ADMCKD2); Phenylketonuria (PAH, PKU1, QDPR, DHPR, PTS); Polycystic kidney and hepatic disease (FCYT, PKHD1, ARPKD, PKD1, PKD2, PKD4, PKDTS, PRKCSH, G19P1, PCLD, SEC63). Other preferred targets include any one or more of include one or more of: PCSK9; Hmger; SERPINA1; ApoB; LDL; Huntington disease (Huntington), Hemochromatosis (HEF), Duchenne muscular dystrophy (Dystrophin), Sickle cell anemia (Beta Globin), and Tay-Sachs (hexosaminidase A)

It will be appreciated that where reference is made to a use or method of treating or modifying an organism or mammal including human or a non-human mammal or organism by manipulation of a target editing site in a genomic locus of interest, this may apply to the organism (or mammal) as a whole or just a single cell or population of cells from that organism (if the organism is multicellular). In the case of humans, for instance, Applicants envisage, inter alia, a single cell or a population of cells and these may preferably be modified ex vivo and then re-introduced. In this case, a biopsy or other tissue or biological fluid sample may be necessary. Stem cells are also particularly preferred in this regard. But, of course, in vivo embodiments are also envisaged.

The method or use may be ex vivo or in vitro, for instance in a cell culture or in an ex vivo or in vitro model (such as an organoid or 'animal or plant cell on a chip'). Alternatively, the method may be in vivo, in which case it may also include isolating the first population of cells from the subject and transplanting the second population of cells (back) into the subject. Gene perturbation may be for one or more, or two or more, or three or more, or four or more genes.

Related Disclosure

Target Sequences or Target Genes: Embodiments of the polynucleotides, compositions, engineered systems, and methods disclosed herein are useful in editing or effecting a sequence-specific modification of a target DNA sequence or target gene in a DNA molecule, a chromosome, or a genome. In embodiments, the target sequence or target gene includes coding sequence (DNA encoding a polypeptide, such as a structural protein or an enzyme), non-coding sequence, or both coding and non-coding sequence. In embodiments, the target sequence or target gene is a gene of a pest or pathogen of a non-human animal, a human, or a plant; important target genes include genes of invertebrate pests (e.g., arthropods, nematodes, and mollusks) of plants, and invertebrate parasites of animals. In embodiments, the target sequence or target gene includes regulatory sequence or translatable (coding) sequence for genes encoding transcription factors and genes encoding enzymes involved in the biosynthesis or catabolism of molecules of interest (such as, but not limited to, amino acids, fatty acids and other lipids, sugars and other carbohydrates, biological polymers, and secondary metabolites including alkaloids, terpenoids, polyketides, non-ribosomal peptides, and secondary metabolites of mixed biosynthetic origin). In embodiments, the target gene is an endogenous gene of a eukaryotic cell; in other embodiments, the target gene is an exogenous gene (e.g., a transgene) in a eukaryotic cell. In embodiments, the target sequence or target gene is a gene that is involved in one or more small RNA-mediated (sRNA-mediated) silencing pathways, i.e., a gene involved in RNA-mediated sequence-specific inhibition of gene expression wherein silencing may occur at transcription, post-transcription, or translation, and wherein the sRNA-mediated silencing pathways can be classified by the biosynthesis, biogenesis, and recognition of types of regulatory sRNAs, e.g., short interfering RNAs (siRNAs), microRNAs (miRNAs), and phased sRNAs; possible target sequences include DNA encoding a regulatory RNA (e.g., DNA encoding a pre-miRNA or miRNA precursor, or DNA encoding a recognition site for a mature miRNA or an siRNA) and DNA encoding any of the participating sRNA silencing pathway proteins (e.g., RDR6, SDE3, RDR2, WEX, SGS3, DCL2-4, UPF1, UPF3, HEN1, NRPDIA, NRPD2, DRD1, HDA6, AGO1, and MOP1); see, e.g., U.S. Pat. No. 9,222,100, incorporated herein by reference. Examples of non-coding sequences include DNA encoding long non-coding RNAs (lncRNAs), DNA encoding microRNAs (miRNAs), DNA encoding tRNAs or ribosomal RNAs (rRNAs), DNA encoding untranscribed regions that are located 5' to or 3' to DNA encoding a polypeptide, and DNA encoding regulatory elements (e.g., promoters, enhancers, introns, terminators, silencers, insulators). In embodiments, the target DNA is genomic DNA, e.g., genomic DNA or nuclear DNA of a eukaryote. In embodiments, the target DNA is mitochondrial or plastid DNA, e.g., mitochondrial DNA of a non-human animal, an animal, or a plant, or plastid DNA of a plant or eukaryotic alga.

Eukaryotic Cells and Eukaryotic Species of Interest: Embodiments of the polynucleotides, compositions, engineered systems, and methods disclosed herein are useful in genome editing of eukaryotes, cells of eukaryotes, and DNA obtained from eukaryotes. In embodiments, the polynucleotides, compositions, engineered systems, and methods disclosed herein are useful in genome editing of non-human animals and non-human animal cells, non-human animal stem cells, human cells, human stem cells, and human somatic (non-gametic) cells; isolated tissue (e.g., nervous tissue, epithelial tissue, liver, spleen, pancreas, muscle tissue, bone, connective tissue, endocrine system tissues, and tumours) or cells (e.g., blood cells, erythrocytes, leukocytes, lymphocytes, liver cells, bone cells, immune cells, T cells, B cells, dendritic cells, and tumour cells) or cell organelles (e.g., mitochondria or chloroplasts, either isolated or contained within the eukaryotic cell, tissue, or organism) obtained from a non-human animal or from a human; engineered hybridoma cells; fungi, fungal cells, plants, plant tissue, plant cells, and seeds. In embodiments, the polynucleotides, compositions, engineered systems, and methods disclosed herein are useful in genome editing of a non-human animal cell (e.g., a cell of an animal selected from the group consisting of invertebrates, vertebrates, insects, arthropods, mollusks, fish, reptiles, amphibians, birds, mammals, primates, and non-human primates), a human cell, a plant cell, or a fungal cell. In embodiments, the eukaryotic cell, tissue, or cell organelle is obtained from an economically or agriculturally important animal species, such as, but not limited to, bees, fruit flies, shrimp, oysters, clams, mussels, salmon, trout, carp, tilapia, catfish, barramundi, striped bass, pigeons, chickens, turkeys, ducks, geese, goats, sheep, cattle, water buffalo, horses, pigs, dogs, cats, rabbits, mice, and rats. In embodiments, the eukaryotic cell is in vitro, ex vivo, or in vivo. In embodiments, the eukaryotic cell is a non-human animal stem cell or a non-human animal gametic cell, from which a non-animal tissue or even an intact animal can be developed. In embodiments, the polynucleotides, compositions, engineered systems, and methods disclosed herein are useful in editing of eukaryotic DNA (e.g., genomic DNA) in vitro. In embodiments, the polynucleotides encoding the Cas12a nuclease and Cas12a nuclease variants described herein are codon-optimized, in whole or in part, for the eukaryotic species wherein the Cas12a editing system is to be employed. In an embodiment, a codon-optimized polynucleotide encoding a Cas12a nuclease contains one or more codons selected for having a high frequency for specifying a given amino acid in the eukaryotic species in which the codon-optimized polynucleotide is to be introduced or expressed. Codon usage or bias is known in the art for various eukaryotes; see, e.g., Quax et al. (2015) Molecular Cell, 59:149-161. See also U.S. Pat. No. 6,015,891, incorporated herein by reference.

In embodiments, the polynucleotides, compositions, engineered systems, and methods disclosed herein are useful in genome editing of plants, plant tissue (including callus), plant cells, or plant protoplasts obtained from any monocot or dicot plant species of interest, for example, row crop plants, fruit-producing plants and trees, vegetables, trees, and ornamental plants including ornamental flowers, shrubs, trees, groundcovers, and turf grasses. Examples of plants, plant tissue, plant cells, or plant protoplasts that are useful in such genome editing include whole plant, intact nodal bud, shoot apex or shoot apical meristem, root apex or root apical meristem, lateral meristem, intercalary meristem, seedling, whole seed, halved seed or other seed fragment, zygotic embryo, somatic embryo, ovule, pollen, microspore, anther, hypocotyl, cotyledon, leaf, petiole, stem, tuber, root, callus, or plant cell or plant protoplast cultures. Plants or plant tissues or cells can be haploid, inducibly haploid, haploid-inducing, diploid, or polyploid. Plant species of interest include, but are not limited to, alfalfa (*Medicago sativa*), almonds (*Prunus dulcis*), apples (*Malus×domestica*), apricots (*Prunus armeniaca, P. brigantine, P. mandshurica, P. mume, P. sibirica*), asparagus (*Asparagus officinalis*), bananas (*Musa* spp.), barley (*Hordeum vulgare*), beans (*Phaseolus* spp.), blueberries and cranberries (*Vaccinium* spp.), cacao (*Theobroma cacao*), canola and rapeseed or oilseed rape, (*Brassica napus*), carnation (*Dianthus caryophyllus*), carrots (*Daucus carota sativus*), cassava (*Manihot esculentum*), cherry (*Prunus avium*), chickpea (Cider *arietinum*), chicory (*Cichorium intybus*), chili peppers and other capsicum peppers (*Capsicum annuum, C. frutescens, C. chinense, C. pubescens, C. baccatum*), chrysanthemums (*Chrysanthemum* spp.), coconut (*Cocos nucifera*), coffee (*Coffea* spp. including *Coffea arabica* and *Coffea canephora*), cotton (*Gossypium hirsutum* L.), cowpea (*Vigna unguiculata*), cucumber (*Cucumis sativus*), currants and gooseberries (*Ribes* spp.), eggplant or aubergine (*Solanum melongena*), eucalyptus (*Eucalyptus* spp.), flax (*Linum usitatissumum* L.), geraniums (*Pelargonium* spp.), grapefruit (*Citrus×paradisi*), grapes (*Vitus* spp.) including wine grapes (*Vitus vinifera*), guava (*Psidium guajava*), irises (*Iris* spp.), lemon (*Citrus limon*), lettuce (*Lactuca sativa*), limes (*Citrus* spp.), maize (*Zea mays* L.), mango (*Mangifera indica*), mangosteen (*Garcinia mangostana*), melon (*Cucumis melo*), millets (*Setaria* spp, *Echinochloa* spp, *Eleusine* spp, *Panicum* spp., *Pennisetum* spp.), oats (*Avena sativa*), oil palm (*Ellis quineensis*), olive (*Olea europaea*), onion (*Allium cepa*), orange (*Citrus sinensis*), papaya (*Carica papaya*), peaches and nectarines (*Prunus persica*), pear (*Pyrus* spp.), pea (Pisa *sativum*), peanut (*Arachis hypogaea*), peonies (*Paeonia* spp.), petunias (*Petunia* spp.), pineapple (*Ananas comosus*), plantains (*Musa* spp.), plum (*Prunus domestica*), poinsettia (*Euphorbia pulcherrima*), Polish canola (*Brassica rapa*), poplar (*Populus* spp.), potato (*Solanum tuberosum*), pumpkin (*Cucurbita pepo*), rice (*Oryza sativa* L.), roses (*Rosa* spp.), rubber (*Hevea brasiliensis*), rye (*Secale cereale*), safflower (*Carthamus tinctorius* L), sesame seed (*Sesame indium*), sorghum (*Sorghum bicolor*), soybean (*Glycine max* L.), squash (*Cucurbita pepo*), strawberries (*Fragaria* spp., *Fragaria×ananassa*), sugar beet (*Beta vulgaris*), sugarcanes (*Saccharum* spp.), sunflower (*Helianthus annuus*), sweet potato (*Ipomoea batatas*), tangerine (*Citrus tangerina*), tea (*Camellia sinensis*), tobacco (*Nicotiana tabacum* L.), tomato (*Lycopersicon esculentum*), tulips (*Tulipa* spp.), turnip (*Brassica rapa rapa*), walnuts (*Juglans* spp. L.), watermelon (*Citrulus lanatus*), wheat (*Tritium aestivum*), or yams (*Discorea* spp.).

Nuclease Fusions and Complexes: In embodiments, the Cas12a nuclease is a fusion protein, e.g., wherein the Cas12a nuclease is covalently bound through a peptide bond to a cell-penetrating peptide, a nuclear localization signal peptide, a chloroplast transit peptide, or a mitochondrial targeting peptide; such fusion proteins are conveniently encoded in a single nucleotide sequence, optionally including codons for linking amino acids. In embodiments, the Cas12a nuclease is a fusion protein, wherein the Cas12a nuclease is covalently bound to another polypeptide via a linker polypeptide, for example, via a glycine polymer $(G)_n$, a glycine-serine polymer, a glycine-alanine polymer, and an alanine-serine polymer. In embodiments, the Cas12a nuclease is chemically conjugated to another polypeptide, e.g., via a non-peptide covalent bond. In embodiments, the Cas12a nuclease is associated with another polypeptide via a non-covalent bond. In embodiments, the Cas12a nuclease is a fusion protein, wherein the Cas12a nuclease is covalently bound to a protein (or a domain from a protein) that inhibits transcription (e.g., a protein that represses transcription, recruits transcription inhibitor proteins, modifies a target DNA through a process such as methylation, recruits a DNA modifier, modulates histones associated with a target DNA, recruits a histone modifier such as those that modify acetylation and/or methylation of histones, or similar functions). Examples of proteins (or fragments thereof) that can be used in decrease transcription include but are not limited to: transcriptional repressors such as the Kruppel associated box (KRAB or SKD); KOX1 repression domain; the Mad mSIN3 interaction domain (SID); the ERF repressor domain (ERD), the SRDX repression domain (e.g., for repression in plants), and the like; histone lysine methyltransferases such as Pr-SET7/8, SUV4-20H1, RIZ1, and the like; histone lysine demethylases such as JMJD2A/JHDM3A, JMJD2B, JMJD2C/GASC1, JMJD2D, JARID1A/RBP2, JARID1B/PLU-1, JARID1C/SMCX, JARID1D/SMCY, and the like; histone lysine deacetylases such as HDAC1, HDAC2, HDAC3, HDAC8, HDAC4, HDAC5, HDAC7, HDAC9, SIRT1, SIRT2, HDAC11, and the like; DNA methylases such as HhaI DNA m5c-methyltransferase (M.HhaI), DNA methyltransferase 1 (DNMT1), DNA methyltransferase 3a (DNMT3a), DNA methyltransferase 3b (DNMT3b), MET1, DRM3 (plants), ZMET2, CMT1, CMT2 (plants), and the like; and periphery recruitment elements such as Lamin A, Lamin B, and the like. In embodiments, the Cas12a nuclease is a fusion protein, wherein the Cas12a nuclease is covalently bound to a protein (or a domain from a protein) that increases transcription (e.g., a protein that activates transcription, recruits transcription activator proteins, modifies a target DNA through a process such as demethylation, recruits a DNA modifier, modulates histones associated with a target DNA, recruits a histone modifier such as those that modify acetylation and/or methylation of histones, or similar functions). Examples of proteins (or fragments thereof) that can be used in increase transcription include but are not limited to: transcriptional activators such as VP16, VP64, VP48, VP160, p65 subdomain (e.g., from NFkB), and activation domain of EDLL and/or TAL activation domain (e.g., for activity in plants); histone lysine methyltransferases such as SET1A, SET1B, MLL1 to 5, ASH1, SYMD2, NSD1, and the like; histone lysine demethylases such as JHDM2a/b, UTX, JMJD3, and the like; histone acetyltransferases such as GCN5, PCAF, CBP, p300, TAF1, TIP60/PLIP, MOZ/MYST3, MORF/MYST4, SRC1, ACTR, P160, CLOCK, and the like; and DNA demethylases such as Ten-Eleven Translocation (TET) dioxygenase 1 (TET1CD), TET1, DME, DML1, DML2, ROS1, and the like. In embodiments, the Cas12a nuclease is a fusion protein, wherein the Cas12a nuclease is covalently bound to a heterologous polypeptide that has enzymatic activity that modifies a target nucleic acid (e.g., ssRNA, dsRNA, ssDNA, dsDNA), for example, nuclease activity such as that provided by a restriction enzyme (e.g., FokI nuclease), methyltransferase activity such as that provided by a methyltransferase (e.g., HhaI DNA m5c-methyltransferase, M.HhaI), DNA methyltransferase 1 (DNMT1), DNA methyltransferase 3a (DNMT3a), DNA methyltransferase 3b (DNMT3b), MET1, DRM3 (plants), ZMET2, CMT1, CMT2 (plants), and the like); demethylase activity such as that provided by a demethylase (e.g., Ten-Eleven Translocation (TET) dioxygenase 1 (TET1CD), TET1, DME, DML1, DML2, ROS 1, and the like), DNA repair activity, DNA damage activity, deamination activity such as that provided by a deaminase (e.g., a cytosine deaminase enzyme such as rat APOBEC1), dismutase activity, alkylation activity, depurination activity, oxidation activity, pyrimidine dimer forming activity, integrase activity such as that provided by an integrase and/or resolvase (e.g., Gin invertase such as the hyperactive mutant of the Gin invertase, GinH106Y; human immunodeficiency virus type 1 integrase (IN); Tn3 resolvase; and the like), transposase activity, recombinase activity such as that provided by a recombinase (e.g., catalytic domain of Gin recombinase), polymerase activity, ligase activity, helicase activity, photolyase activity, and glycosylase activity). In embodiments, the Cas12a nuclease is a fusion protein, wherein the Cas12a nuclease is covalently bound to a heterologous polypeptide that has enzymatic activity that modifies a polypeptide (e.g., a histone) associated with a target nucleic acid (e.g., ssRNA, dsRNA, ssDNA, dsDNA), for example, methyltransferase activity such as that provided by a histone methyltransferase (HMT) (e.g., suppressor of variegation 3-9 homolog 1 (SUV39H1, also known as KMTIA), euchromatic histone lysine methyltransferase 2 (G9A, also known as KMT1C and EHMT2), SUV39H2, ESET/SETDB 1, and the like, SET1A, SET1B, MLL1 to 5, ASH1, SYMD2, NSD1, DOT1L, Pr-SET7/8, SUV4-20H1, EZH2, RIZI), demethylase activity such as that provided by a histone demethylase (e.g., Lysine Demethylase 1A (KDM1A also known as LSD1), JHDM2a/b, JMJD2A/JHDM3A, JMJD2B, JMJD2C/GASC1, JMJD2D, JARID1A/RBP2, JARID1B/PLU-1, JARID1C/SMCX, JARID1D/SMCY, UTX, JMJD3, and the like), acetyltransferase activity such as that provided by a histone acetylase transferase (e.g., catalytic core/fragment of the human acetyltransferase p300, GCN5, PCAF, CBP, TAF1, TIP60/PLIP, MOZ/MYST3, MORF/MYST4, HBO1/MYST2, HMOF/MYST1, SRC1, ACTR, P160, CLOCK, and the like), deacetylase activity such as that provided by a histone deacetylase (e.g., HDAC1, HDAC2, HDAC3, HDAC8, HDAC4, HDAC5, HDAC7, HDAC9, SIRT1, SIRT2, HDAC11, and the like), kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, and demyristoylation activity. In embodiments, the Cas12a nuclease is a fusion protein, wherein the Cas12a nuclease is covalently bound to a dihydrofolate reductase (DHFR) destabilization domain (e.g., to generate a chemically controllable chimeric Cas12a nuclease).

In embodiments, the Cas12a nuclease or a polynucleotide that encodes the Cas12a nuclease or a ribonucleoprotein including the Cas12a nuclease is provided as a complex with a cell-penetrating peptide or other transfecting agent. In embodiments, the Cas12a nuclease or a polynucleotide that encodes the Cas12a nuclease or a ribonucleoprotein including the Cas12a nuclease is complexed with, or covalently or non-covalently bound to, a further element, e.g., a carrier molecule, an antibody, an antigen, a viral movement protein, a polymer, a detectable label (e.g., a moiety detectable by fluorescence, radioactivity, or enzymatic or immunochemical reaction), a quantum dot, or a particulate or nanoparticulate.

In some cases, the fusion partner can modulate transcription (e.g., inhibit transcription, increase transcription) of a target DNA. For example, in some cases the fusion partner Vectors: In certain embodiments, a vector or an expression cassette contained in a vector includes additional components, e.g., a polynucleotide encoding a drug resistance or herbicide gene or a polynucleotide encoding a detectable marker such as green fluorescent protein (GFP) or beta-glucuronidase (gus) to allow convenient screening or selection of cells expressing the vector. In embodiments, the vector or expression cassette includes additional elements for improving delivery to a plant cell or plant protoplast or for directing or modifying expression of one or more genome-editing system elements, for example, fusing a sequence encoding a cell-penetrating peptide, localization signal, transit, or targeting peptide to the Cas12a nuclease, or adding a nucleotide sequence to stabilize a guide RNA; such fusion proteins (and the polypeptides encoding such fusion proteins) or combination polypeptides, as well as expression cassettes and vectors for their expression in a cell, are specifically claimed. In embodiments, a Cas12a nuclease is fused to a localization signal, transit, or targeting peptide, e.g., a nuclear localization signal (NLS), a chloroplast transit peptide (CTP), or a mitochondrial targeting peptide (MTP); in a vector or an expression cassette, the nucleotide sequence encoding any of these can be located either 5' and/or 3' to the DNA encoding the nuclease. CRISPR nuclease fusion proteins containing nuclear localization signals and codon-optimized for expression in maize are disclosed in U.S. patent application Ser. No. 15/120,110, published as U.S. Patent Application Publication 2017/0166912, national phase application claiming priority to PCT/US2015/018104 (published as WO/2015/131101 and claiming priority to U.S. Provisional Patent Application 61/945,700), incorporated herein by reference. In another example, a chloroplast-targeting RNA is appended to the 5' end of an mRNA encoding an endonuclease to drive the accumulation of the mRNA in chloroplasts; see Gomez, et al. (2010) Plant Signal Behav., 5: 1517-1519. In an embodiment, a Cas12a nuclease is fused to a nuclear localization signal (NLS), such as the NLS from SV40. In an embodiment, a Cas12a nuclease is fused to a cell-penetrating peptide (CPP), such as octa-arginine or nona-arginine or a homoarginine 12-mer oligopeptide, or a CPP disclosed in the database of cell-penetrating peptides CPPsite 2.0, publicly available at crdd[dot]osdd [dot]net/raghava/cppsite/. In an embodiment, a Cas12a nuclease is fused to a chloroplast transit peptide (CTP) sequence. In embodiments, a CTP sequence is obtained from any nuclear gene that encodes a protein that targets a chloroplast, and the isolated or synthesized CTP DNA is appended to the 5' end of the DNA that encodes a Cas12a nuclease targeted for use in a chloroplast. Chloroplast transit peptides and their use are described in U.S. Pat. Nos. 5,188,642, 5,728,925, and 8,420,888, all of which are incorporated herein by reference in their entirety. Specifically, the CTP nucleotide sequences provided with the sequence identifier (SEQ ID) numbers 12-15 and 17-22 of U.S. Pat. No. 8,420,888 are incorporated herein by reference. In an embodiment, a Cas12a nuclease is fused to a mitochondrial targeting peptide (MTP), such as a plant MTP sequence; see, e.g., Jores et al. (2016) *Nature Communications,* 7:12036-12051.

Plasmids designed for use in plants and encoding CRISPR genome editing elements (CRISPR nucleases and guide RNAs) are publicly available from plasmid repositories such as Addgene (Cambridge, Massachusetts; also see "addgene [dot]com") or can be designed using publicly disclosed sequences, e.g., sequences of CRISPR nucleases. In embodiments, such plasmids are used to co-express both Cas12a nuclease mRNA and guide RNA(s) (Cas12a crRNA(s)); in other embodiments, Cas12a nuclease mRNA and guide RNA (Cas12a crRNA) are encoded on separate plasmids. In embodiments, the plasmids are *Agrobacterium* TI plasmids. Materials and methods for preparing expression cassettes and vectors for CRISPR endonuclease and guide RNA for stably integrated and/or transient plant transformation are disclosed in U.S. patent application Ser. No. 15/120,110, published as U.S. Patent Application Publication 2017/0166912, national phase application claiming priority to PCT/US2015/018104 (published as WO/2015/131101 and claiming priority to U.S. Provisional Patent Application 61/945,700), U.S. Patent Application Publication 2015/0082478 A1, and PCT/US2015/038767 (published as WO/2016/007347 and claiming priority to U.S. Provisional Patent Application 62/023,246), all of which are incorporated herein by reference in their entirety. In embodiments, such expression cassettes are isolated linear fragments, or are part of a larger construct that includes bacterial replication elements and selectable markers; such embodiments are useful, e.g., for particle bombardment or nanoparticle delivery or protoplast transformation. In embodiments, the expression cassette is adjacent to or located between T-DNA borders or contained within a binary vector, e.g., for *Agrobacterium*-mediated transformation. In embodiments, a plasmid encoding a Cas12a nuclease is delivered to a cell (such as a plant cell or a plant protoplast) for stable integration of the Cas12a nuclease into the genome of the cell, or alternatively for transient expression of the Cas12a nuclease. In embodiments, plasmids encoding a Cas12a nuclease are delivered to a plant cell or a plant protoplast to achieve stable or transient expression of the Cas12a nuclease, and one or multiple guide RNAs (Cas12a crRNAs) (such as a library of individual guide RNAs or multiple pooled guide RNAs) or plasmids encoding the guide RNAs are delivered to the plant cell or plant protoplast individually or in combinations, thus providing libraries or arrays of plant cells or plant protoplasts (or of plant callus or whole plants derived therefrom), in which a variety of genome edits are provided by the different guide RNAs (Cas12a crRNAs).

In embodiments, the polynucleotides, ribonucleoproteins, DNA expression systems, and engineered systems are delivered to a eukaryotic cell using a viral vector. Viral vectors especially useful in animal cells include viral vectors based on vaccinia virus; poliovirus; adenovirus (see, e.g., Li et al., Invest Opthalmol Vis Sci 35:2543 2549, 1994; Borras et al, Gene Ther 6:515 524, 1999; Li and Davidson, PNAS 92:7700 7704, 1995; Sakamoto et al., H Gene Ther 5: 1088 1097, 1999; WO 94/12649, WO 93/03769; WO 93/19191; WO 94/28938; WO 95/11984 and WO 95/00655); adeno-associated virus (AAV) (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90: 10613-10617); SV40; herpes simplex virus; human immunodeficiency virus (see, e.g., Miyoshi et al., PNAS 94: 10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus); and the like. In some cases, a recombinant expression vector of the present disclosure is a recombinant adeno-associated virus (AAV) vector. In some cases, a recombinant expression vector of the present disclosure is a recombinant lentivirus vector. In some cases, a recombinant expression vector of the present disclosure is a recombinant retroviral vector. Viral vectors especially useful in plant cells include geminiviruses, begomoviruses, tobamoviruses, potex viruses, comoviruses, wheat streak mosaic virus, barley stripe mosaic virus, bean yellow dwarf virus, bean pod mottle virus, cabbage leaf curl virus, beet curly top virus, tobacco yellow dwarf virus, tobacco rattle virus, potato virus X, and cowpea mosaic virus.

In embodiments, the polynucleotides, ribonucleoproteins, DNA expression systems, and engineered systems are delivered to a plant cell using a bacterial vector. In embodiments of the method, the engineered system or a component thereof is delivered via at least one bacterial vector capable of transforming a plant cell and selected from the group consisting of *Agrobacterium* sp., *Rhizobium* sp., *Sinorhizobium* (Ensifer) sp., *Mesorhizobium* sp., *Bradyrhizobium* sp., *Azobacter* sp., and *Phyllobacterium* sp.

Delivery Methods and Delivery Agents: The polynucleotides, ribonucleoproteins, DNA expression systems, engineered systems, and vectors (collectively referred to here as "genome editing reagents") that are aspects of the invention can be delivered to a eukaryotic cell, such as a plant cell, using various techniques and agents. In embodiments, one or more treatments is employed to deliver genome editing reagents into a plant cell or plant protoplast, e.g., through barriers such as a cell wall or a plasma membrane or nuclear envelope or other lipid bilayer. In an embodiment, genome editing reagents are delivered directly, for example by direct contact of the polynucleotide composition with a plant cell or plant protoplast. A genome editing reagent-containing composition in the form of a liquid, a solution, a suspension, an emulsion, a reverse emulsion, a colloid, a dispersion, a gel, liposomes, micelles, an injectable material, an aerosol, a solid, a powder, a particulate, a nanoparticle, or a combination thereof can be applied directly to a eukaryotic cell, such as a non-human animal cell, a human cell, a fungal cell, or a plant cell or plant protoplast (e.g., through abrasion or puncture or otherwise disruption of the cell wall or cell membrane, by spraying or dipping or soaking or otherwise directly contacting, by microinjection). For example, a eukaryotic cell, such as a non-human animal cell, a human cell, a fungal cell, or a plant cell or plant protoplast is soaked in a liquid genome editing reagent-containing composition, whereby the genome editing reagent is delivered to the plant cell or plant protoplast. In embodiments, the genome editing reagent-containing composition is delivered using negative or positive pressure, for example, using vacuum infiltration or application of hydrodynamic or fluid pressure. In embodiments, the genome editing reagent-containing composition is introduced into a eukaryotic cell, such as a non-human animal cell, a human cell, a fungal cell, or a plant cell or plant protoplast, e.g., by microinjection or by disruption or deformation of the cell wall or cell membrane, for example by physical treatments such as by application of negative or positive pressure, shear forces, or treatment with a chemical or physical delivery agent such as surfactants, liposomes, or nanoparticles; see, e.g., delivery of materials to cells employing microfluidic flow through a cell-deforming constriction as described in U.S. Published Patent Application 2014/0287509, incorporated by reference in its entirety herein. Other techniques useful for delivering the genome editing reagent-containing composition to a eukaryotic cell, such as a non-human animal cell, a human cell, a fungal cell, or a plant cell or plant protoplast include: ultrasound or sonication; vibration, friction, shear stress, vortexing, cavitation; centrifugation or application of mechanical force; mechanical cell wall or cell membrane deformation or breakage; enzymatic cell wall or cell membrane breakage or permeabilization; abrasion or mechanical scarification (e.g., abrasion with carborundum or other particulate abrasive or scarification with a file or sandpaper) or chemical scarification (e.g., treatment with an acid or caustic agent); and electroporation. In embodiments, the genome editing reagent-containing composition is provided to a plant cell or plant protoplast by bacterially mediated (e.g., *Agrobacterium* sp., *Rhizobium* sp., *Sinorhizobium* sp., *Mesorhizobium* sp., *Bradyrhizobium* sp., *Azobacter* sp., *Phyllobacterium* sp.) transfection of the plant cell or plant protoplast with a polynucleotide encoding the gRNA; see, e.g., Broothaerts et al. (2005) *Nature*, 433:629-633. Any of these techniques or a combination thereof are alternatively employed on the plant part or tissue or intact plant (or seed) from which a plant cell or plant protoplast is optionally subsequently obtained or isolated; in embodiments, the genome editing reagent-containing composition is delivered in a separate step after the plant cell or plant protoplast has been obtained or isolated.

In embodiments, a treatment employed in delivery of a genome editing reagent to a eukaryotic cell, such as a non-human animal cell, a human cell, a fungal cell, or a plant cell or plant protoplast is carried out under a specific thermal regime, which can involve one or more appropriate temperatures, e.g., chilling or cold stress (exposure to temperatures below that at which normal growth of the eukaryotic cell occurs), or heating or heat stress (exposure to temperatures above that at which normal growth of the eukaryotic cell occurs), or treating at a combination of different temperatures. In embodiments, a specific thermal regime is carried out on the eukaryotic cell, such as a non-human animal cell, a human cell, a fungal cell, or plant cell or plant protoplast, in one or more steps separate from the genome editing reagent delivery. In embodiments, a specific thermal regime is carried out on a plant cell or plant protoplast, or on a plant or plant part from which a plant cell or plant protoplast is subsequently obtained or isolated, in one or more steps separate from the genome editing reagent delivery.

A Cas12a nuclease or a polynucleotide that encodes the Cas12a nuclease or a ribonucleoprotein including the Cas12a nuclease can be provided to a cell (e.g., a plant cell) by any suitable technique. In embodiments, the Cas12a nuclease or a polynucleotide that encodes the Cas12a nuclease or a ribonucleoprotein including the Cas12a nuclease is provided in a solution, or is provided in a liposome, micelle, emulsion, reverse emulsion, suspension, or other mixed-phase composition. In embodiments, the Cas12a nuclease or a polynucleotide that encodes the Cas12a nuclease or a ribonucleoprotein including the Cas12a nuclease is provided by directly contacting a plant cell or plant protoplast with the Cas12a nuclease or a polynucleotide that encodes the Cas12a nuclease or a ribonucleoprotein including the Cas12a nuclease. In embodiments, the Cas12a nuclease or a polynucleotide that encodes the Cas12a nuclease or a ribonucleoprotein including the Cas12a nuclease is provided by transporting the Cas12a nuclease or a polynucleotide that encodes the Cas12a nuclease or a ribonucleoprotein including the Cas12a nuclease into a plant cell or plant protoplast using a chemical, enzymatic, or physical agent. In embodiments, the Cas12a nuclease is provided by bacterially mediated (e.g., *Agrobacterium* sp., *Rhizobium* sp., *Sinorhizobium* sp., *Mesorhizobium* sp., *Bradyrhizobium* sp., *Azobacter* sp., *Phyllobacterium* sp.) transfection of a plant cell or plant protoplast with a polynucleotide encoding the Cas12a nuclease; see, e.g., Broothaerts et al. (2005) *Nature*, 433:629-633. In an embodiment, the Cas12a nuclease is provided by transcription in a plant cell or plant protoplast of a DNA that encodes the Cas12a nuclease and is stably integrated in the genome of the plant cell or plant protoplast or that is provided to the plant cell or plant protoplast in the form of a plasmid or expression vector (e.g., a viral vector) that encodes the Cas12a nuclease. In embodiments, the Cas12a nuclease is provided to the plant cell or plant protoplast as a polynucleotide that encodes the Cas12a nuclease, e.g., in the form of an mRNA encoding the nuclease.

In embodiments, a whole plant or plant part or seed, or an isolated plant cell or plant protoplast, or the plant or plant part from which a plant cell or plant protoplast is obtained or isolated, is treated with one or more delivery agents which can include at least one chemical, enzymatic, or physical agent, or a combination thereof. In embodiments, a genome editing reagent-containing composition further includes one or more one chemical, enzymatic, or physical agent for delivery. Treatment with the chemical, enzymatic or physical agent can be carried out simultaneously with the genome editing reagent delivery, or in one or more separate steps that precede or follow the genome editing reagent delivery. In embodiments, a chemical, enzymatic, or physical agent, or a combination of these, is associated or complexed with a genome editing reagent composition; examples of such associations or complexes include those involving non-covalent interactions (e.g., ionic or electrostatic interactions, hydrophobic or hydrophilic interactions, formation of liposomes, micelles, or other heterogeneous composition) and covalent interactions (e.g., peptide bonds, bonds formed using cross-linking agents). In non-limiting examples, a genome editing reagent is provided as a liposomal complex with a cationic lipid, or as a complex with a carbon nanotube, or as a fusion protein between the nuclease and a cell-penetrating peptide. Examples of agents useful for delivering a genome editing reagent include the various cationic liposomes and polymer nanoparticles reviewed by Zhang et al. (2007) *J. Controlled Release*, 123:1-10, and the cross-linked multilamellar liposomes described in U.S. Patent Application Publication 2014/0356414 A1, incorporated by reference in its entirety herein.

In embodiments, the chemical agent is at least one selected from the group consisting of:

(a) solvents (e.g., water, dimethylsulfoxide, dimethylformamide, acetonitrile, N-pyrrolidine, pyridine, hexamethylphosphoramide, alcohols, alkanes, alkenes, dioxanes, polyethylene glycol, and other solvents miscible or emulsifiable with water or that will dissolve phosphonucleotides in non-aqueous systems);

(b) fluorocarbons (e.g., perfluorodecalin, perfluoromethyldecalin);

(c) glycols or polyols (e.g., propylene glycol, polyethylene glycol);

(d) surfactants, including cationic surfactants, anionic surfactants, non-ionic surfactants, and amphiphilic surfactants, e.g., alkyl or aryl sulfates, phosphates, sulfonates, or carboxylates; primary, secondary, or tertiary amines; quaternary ammonium salts; sultaines, betaines; cationic lipids; phospholipids; tallowamine; bile acids such as cholic acid; long chain alcohols; organosilicone surfactants including nonionic organosilicone surfactants such as trisiloxane ethoxylate surfactants or a silicone polyether copolymer such as a copolymer of polyalkylene oxide modified heptamethyl trisiloxane and allyloxypolypropylene glycol methylether (commercially available as SILWET L-77™ brand surfactant having CAS Number 27306-78-1 and EPA Number CAL. REG. NO. 5905-50073-AA, Momentive Performance Materials, Inc., Albany, New York); specific examples of useful surfactants include sodium lauryl sulfate, the Tween series of surfactants, Triton-X100, Triton-X114, CHAPS and CHAPSO, Tergitol-type NP-40, Nonidet P-40;

(e) lipids, lipoproteins, lipopolysaccharides;

(f) acids, bases, caustic agents;

(g) peptides, proteins, or enzymes (e.g., cellulase, pectolyase, macroenzyme, pectinase), including cell-penetrating or pore-forming peptides (e.g., (BO100)2K8, Genscript; poly-lysine, poly-arginine, or poly-homoarginine peptides; gamma zein, see U.S. Patent Application publication 2011/0247100, incorporated herein by reference in its entirety; transcription activator of human immunodeficiency virus type 1 ("HIV-1 Tat") and other Tat proteins, see, e.g., www[dot]lifetein[dot]com/Cell Penetrating Peptides[dot]html and Jarver (2012) Mol. Therapy-*Nucleic Acids*, 1:e27, 1-17); octa-arginine or nona-arginine; poly-homoarginine (see Unnamalai et al. (2004) FEBS Letters, 566:307-310); see also the database of cell-penetrating peptides CPPsite 2.0 publicly available at crdd[dot]osdd[dot]net/raghava/cppsite/

(h) RNase inhibitors;

(i) cationic branched or linear polymers such as chitosan, poly-lysine, DEAE-dextran, polyvinylpyrrolidone ("PVP"), orpolyethylenimine ("PEI", e.g., PEI, branched, MW 25,000, CAS #9002-98-6; PEI, linear, MW 5000, CAS #9002-98-6; PEI linear, MW 2500, CAS #9002-98-6);

(j) dendrimers (see, e.g., U.S. Patent Application Publication 2011/0093982, incorporated herein by reference in its entirety);

(k) counter-ions, amines or polyamines (e.g., spermine, spermidine, putrescine), osmolytes, buffers, and salts (e.g., calcium phosphate, ammonium phosphate);

(l) polynucleotides (e.g., non-specific double-stranded DNA, salmon sperm DNA);

(m) transfection agents (e.g., Lipofectin®, Lipofectamine®, and Oligofectamine®, and Invivofectamine® (all from Thermo Fisher Scientific, Waltham, Massachusetts), PepFect (see Ezzat et al. (2011) *Nucleic Acids* Res., 39:5284-5298), TransIt® transfection reagents (Mirus Bio, LLC, Madison, Wisconsin), and poly-lysine, poly-homoarginine, and poly-arginine molecules including octa-arginine and nona-arginine as described in Lu et al. (2010) J. Agric. Food Chem., 58:2288-2294);

(n) antibiotics, including non-specific DNA double-strand-break-inducing agents (e.g., phleomycin, bleomycin, talisomycin); and (o) antioxidants (e.g., glutathione, dithiothreitol, ascorbate).

In embodiments, the chemical agent is provided simultaneously with the genome editing reagent. In embodiments, the genome editing reagent is covalently or non-covalently linked or complexed with one or more chemical agent; for example, a polynucleotide genome editing reagent can be covalently linked to a peptide or protein (e.g., a cell-penetrating peptide or a pore-forming peptide) or non-covalently complexed with cationic lipids, polycations (e.g., polyamines), or cationic polymers (e.g., PEI). In embodiments, the genome editing reagent is complexed with one or more chemical agents to form, e.g., a solution, liposome, micelle, emulsion, reverse emulsion, suspension, colloid, or gel.

In embodiments, the physical agent is at least one selected from the group consisting of particles or nanoparticles (e.g., particles or nanoparticles made of materials such as carbon, silicon, silicon carbide, gold, tungsten, polymers, or ceramics) in various size ranges and shapes, magnetic particles or nanoparticles (e.g., silenceMag Magnetotransfection™ agent, OZ Biosciences, San Diego, California), abrasive or scarifying agents, needles or microneedles, matrices, and grids. In embodiments, particulates and nanoparticulates are useful in delivery of the polynucleotide composition or the nuclease or both. Useful particulates and nanoparticles include those made of metals (e.g., gold, silver, tungsten, iron, cerium), ceramics (e.g., aluminum oxide, silicon carbide, silicon nitride, tungsten carbide), polymers (e.g., polystyrene, polydiacetylene, and poly(3,4-ethylenedioxythiophene) hydrate), semiconductors (e.g., quantum dots), silicon (e.g., silicon carbide), carbon (e.g., graphite, graphene, graphene oxide, or carbon nanosheets, nanocomplexes, or nanotubes), and composites (e.g., polyvinylcarbazole/graphene, polystyrene/graphene, platinum/graphene, palladium/graphene nanocomposites). In embodiments, such particulates and nanoparticulates are further covalently or non-covalently functionalized, or further include modifiers or cross-linked materials such as polymers (e.g., linear or branched polyethylenimine, poly-lysine), polynucleotides (e.g., DNA or RNA), polysaccharides, lipids, polyglycols (e.g., polyethylene glycol, thiolated polyethylene glycol), polypeptides or proteins, and detectable labels (e.g., a fluorophore, an antigen, an antibody, or a quantum dot). In various embodiments, such particulates and nanoparticles are neutral, or carry a positive charge, or carry a negative charge. Embodiments of compositions including particulates include those formulated, e.g., as liquids, colloids, dispersions, suspensions, aerosols, gels, and solids. Embodiments include nanoparticles affixed to a surface or support, e.g., an array of carbon nanotubes vertically aligned on a silicon or copper wafer substrate. Embodiments include polynucleotide compositions including particulates (e.g., gold or tungsten or magnetic particles) delivered by a Biolistic-type technique or with magnetic force. The size of the particles used in Biolistics is generally in the "microparticle" range, for example, gold microcarriers in the 0.6, 1.0, and 1.6 micrometer size ranges (see, e.g., instruction manual for the Helios® Gene Gun System, Bio-Rad, Hercules, California; Randolph-Anderson et al. (2015) "Sub-micron gold particles are superior to larger particles for efficient Biolistic® transformation of organelles and some cell types", Bio-Rad US/EG Bulletin 2015), but successful Biolistics delivery using larger (40 nanometer) nanoparticles has been reported in cultured animal cells; see O'Brian and Lummis (2011) *BMC Biotechnol.*, 11:66-71. Other embodiments of useful particulates are nanoparticles, which are generally in the nanometer (nm) size range or less than 1 micrometer, e.g., with a diameter of less than about 1 nm, less than about 3 nm, less than about 5 nm, less than about 10 nm, less than about 20 nm, less than about 40 nm, less than about 60 nm, less than about 80 nm, and less than about 100 nm. Specific, non-limiting embodiments of nanoparticles commercially available (all from Sigma-Aldrich Corp., St. Louis, MO) include gold nanoparticles with diameters of 5, 10, or 15 nm; silver nanoparticles with particle sizes of 10, 20, 40, 60, or 100 nm; palladium "nanopowder" of less than 25 nm particle size; single-, double-, and multi-walled carbon nanotubes, e.g., with diameters of 0.7-1.1, 1.3-2.3, 0.7-0.9, or 0.7-1.3 nm, or with nanotube bundle dimensions of 2-10 nm by 1-5 nm, 6-9 nm by 5 micrometers, 7-15 nm by 0.5-10 micrometers, 7-12 nm by 0.5-10 micrometers, 110-170 nm by 5-9 micrometers, 6-13 nm by 2.5-20 micrometers. Embodiments include genome editing reagent-containing compositions including materials such as gold, silicon, cerium, or carbon, e.g., gold or gold-coated nanoparticles, silicon carbide whiskers, carborundum, porous silica nanoparticles, gelatin/silica nanoparticles, nanoceria or cerium oxide nanoparticles (CNPs), carbon nanotubes (CNTs) such as single-, double-, or multi-walled carbon nanotubes and their chemically functionalized versions (e.g., carbon nanotubes functionalized with amide, amino, carboxylic acid, sulfonic acid, or polyethylene glycol moieties), and graphene or graphene oxide or graphene complexes; see, for example, Wong et al. (2016) *Nano Lett.*, 16:1161-1172; Giraldo et al. (2014) *Nature Materials*, 13:400-409; Shen et al. (2012) *Theranostics*, 2:283-294; Kim et al. (2011) *Bioconjugate Chem.*, 22:2558-2567; Wang et al. (2010) *J. Am. Chem. Soc. Comm.*, 132:9274-9276; Zhao et al. (2016) *Nanoscale Res. Lett.*, 11:195-203; and Choi et al. (2016) *J. Controlled Release*, 235:222-235. See also, for example, the various types of particles and nanoparticles, their preparation, and methods for their use, e.g., in delivering polynucleotides and polypeptides to cells, disclosed in U.S. Patent Application Publications 2010/0311168, 2012/0023619, 2012/0244569, 2013/0145488, 2013/0185823, 2014/0096284, 2015/0040268, 2015/0047074, and 2015/0208663, all of which are incorporated herein by reference in their entirety.

In embodiments, a genome editing reagent is delivered to plant cells or plant protoplasts prepared or obtained from a plant, plant part, or plant tissue that has been treated with the polynucleotide compositions (and optionally the nuclease). In embodiments, one or more one chemical, enzymatic, or physical agent, separately or in combination with the genome editing reagent, is provided/applied at a location in the plant or plant part other than the plant location, part, or tissue from which the plant cell or plant protoplast is obtained or isolated. In embodiments, the genome editing reagent is applied to adjacent or distal cells or tissues and is transported (e.g., through the vascular system or by cell-to-cell movement) to the meristem from which plant cells or plant protoplasts are subsequently isolated. In embodiments, a genome editing reagent-containing composition is applied by soaking a seed or seed fragment or zygotic or somatic embryo in the genome editing reagent-containing composition, whereby the genome editing reagent is delivered to the seed or seed fragment or zygotic or somatic embryo from which plant cells or plant protoplasts are subsequently isolated. In embodiments, a flower bud or shoot tip is contacted with a genome editing reagent-containing composition, whereby the genome editing reagent is delivered to cells in the flower bud or shoot tip from which plant cells or plant protoplasts are subsequently isolated. In embodiments, a genome editing reagent-containing composition is applied to the surface of a plant or of a part of a plant (e.g., a leaf surface), whereby the genome editing reagent is delivered to tissues of the plant from which plant cells or plant protoplasts are subsequently isolated. In embodiments a whole plant or plant tissue is subjected to particle- or nanoparticle-mediated delivery (e.g., Biolistics or carbon nanotube or nanoparticle delivery) of a genome editing reagent-containing composition, whereby the genome editing reagent is delivered to cells or tissues from which plant cells or plant protoplasts are subsequently isolated.

EXAMPLES

Example 1

This example illustrates techniques for identifying trans-activating CRISPR (tracrRNA) sequences that are useful in compositions and methods of the invention. More specifically, this example provides examples of Cas12a tracrRNA sequences identified from *Lachnospiraceae bacterium* ND2006 ("Lb") and *Acidaminococcus* sp. BV3L6 ("As").

Steps for identifying tracrRNA sequences have been described, e.g., in U.S. Pat. No. 9,790,490, incorporated here by reference: "Identification of tracr sequences may relate to the following steps: Search for the direct repeats or tracr mate sequences in a database to identify a CRISPR region comprising a CRISPR enzyme. Search for homologous sequences in the CRISPR region flanking the CRISPR enzyme in both the sense and antisense directions. Look for transcriptional terminators and secondary structures. Identify any sequence that is not a direct repeat or a tracr mate sequence but has more than 50% identity to the direct repeat or tracr mate sequence as a potential tracr sequence. Take the potential tracr sequence and analyze for transcriptional terminator sequences associated therewith." RNA sequencing can be used to further characterize such sequences identified as potential or putative tracrRNAs.

Similar techniques are used to identify putative tracrRNA sequences for Cas12a (Cpf1) nucleases from *Lachnospiraceae bacterium* ND2006 ("Lb") and *Acidaminococcus* sp. BV3L6 ("As"). The techniques employed include: identifying sequences that are located in the CRISPR region flanking the DNA encoding the CRISPR nuclease and that have a nucleotide sequence that permits the transcribed tracrRNA to hybridize to the crRNA (i.e., the transcribed tracrRNA has sufficient complementarity to a crRNA sequence to hybridize to the crRNA), and searching for the presence of a predicted transcriptional terminator in direction of transcription. Sequences having at least 50% sequence identity to the direct repeat in a corresponding CRISPR array are identified as potential tracrRNA sequences; sequences having slightly less than 50% sequence identity to the direct repeat are also evaluated. In this non-limiting example, putative tracrRNA sequences are identified having lengths of between 65 to 84 nucleotides and between 50.0% to 52.8% sequence identity to the direct repeat.

Figure 2:
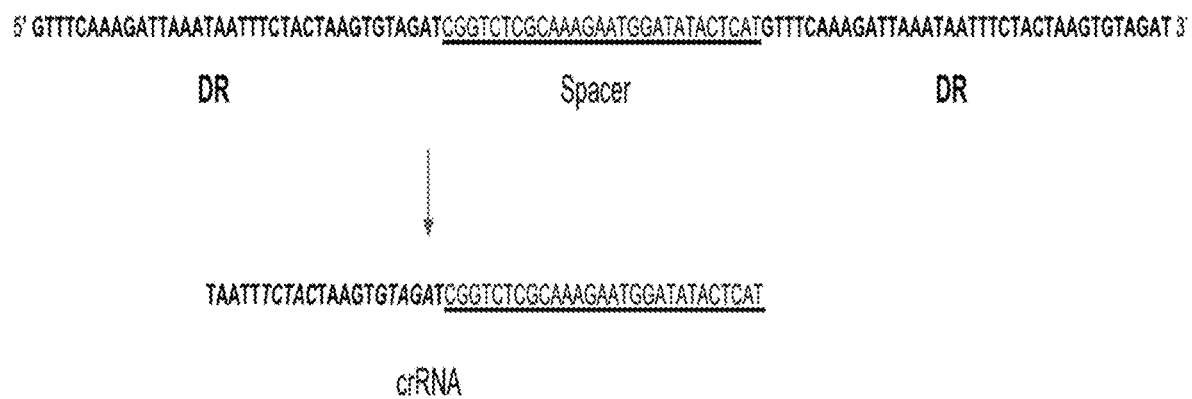
FIG. 2 illustrates a segment of the LbCpf1 CRISPR locus (SEQ ID NO: 242) as described in detail in Example 1, showing the arrangement in a CRISPR array of the LbCpf1 direct repeats ("DR", in bold font) (SEQ ID NO:173) flanking a spacer sequence ("spacer", in underlined font) (SEQ ID NO: 174), and illustrating the predicted crRNA (SEQ ID NO:175) processing from this CRISPR array. The DR, spacer, and predicted crRNA sequences are provided as DNA equivalents.

FIG. 1 illustrates schematics of the *Lachnospiraceae bacterium* ND2006 Cas12a ("LbCpf1") CRISPR locus and putative tracrRNA location; the schematics are shown with (upper figure) and without (lower figure) the Cas4 and Cas2 components of the locus. FIG. 2 illustrates a segment of the LbCpf1 CRISPR locus, showing the arrangement in a CRISPR array of the LbCpf1 direct repeats ("DR", in bold font) flanking a spacer sequence ("spacer", in underlined font), and illustrating the predicted crRNA processing from this CRISPR array. The following are identified as putative tracrRNA sequences: LbCpf1 putative tracrRNA 1 (84 nucleotides) having the RNA sequence of SEQ ID NO:1 encoded by the DNA sequence of SEQ ID NO:2, and LbCpf1 putative tracrRNA 2 (65 nucleotides) having the RNA sequence of SEQ ID NO:3 encoded by the DNA sequence of SEQ ID NO:4. FIG. 3 illustrates the alignments of the reverse complement of the LbCpf1 direct repeat (DR) sequence, SEQ ID NO:5, with the LbCpf1 putative tracrRNA 1 (SEQ ID NO:2) (top, showing 52.8% identity between the two sequences) and the LbCpf1 putative tracrRNA 2 (SEQ ID NO:4) (bottom, showing 50.0% identity between the two sequences).

Figure 4:
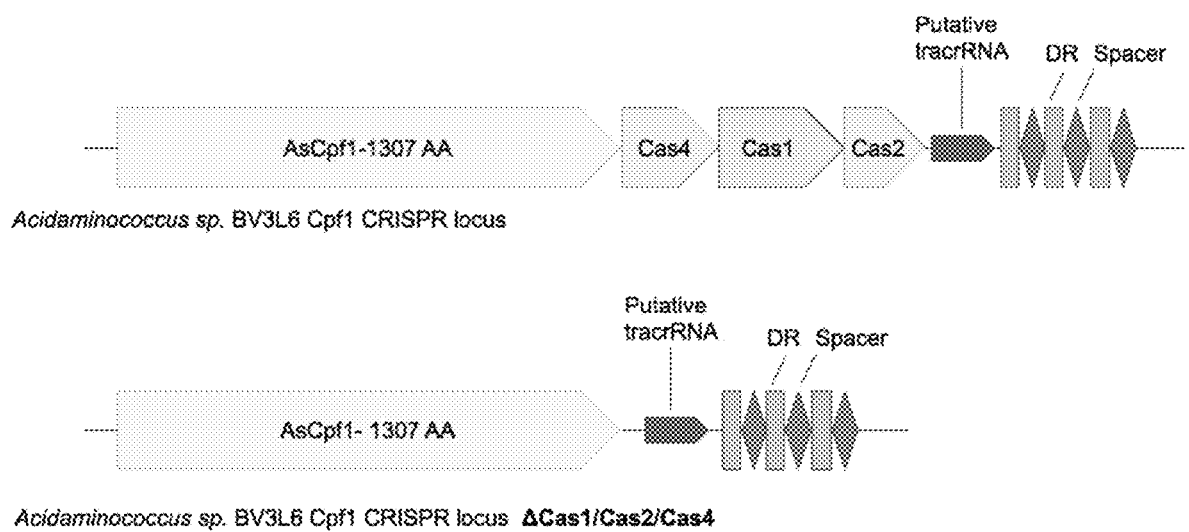
FIG. 4 illustrates schematics of the *Acidaminococcus* sp. BV3L6 ("As") Cas12a ("AsCpf1") CRISPR locus and tracrRNA ("putative tracrRNA") location as described in detail in Example 1. The schematics are shown with (upper figure) and without (lower figure) the Cas 1, Cas2, and Cas4 components of the locus. The direct repeats ("DR") are indicated by upright rectangles and the spacer sequences are indicated by diamonds.
Figure 5:
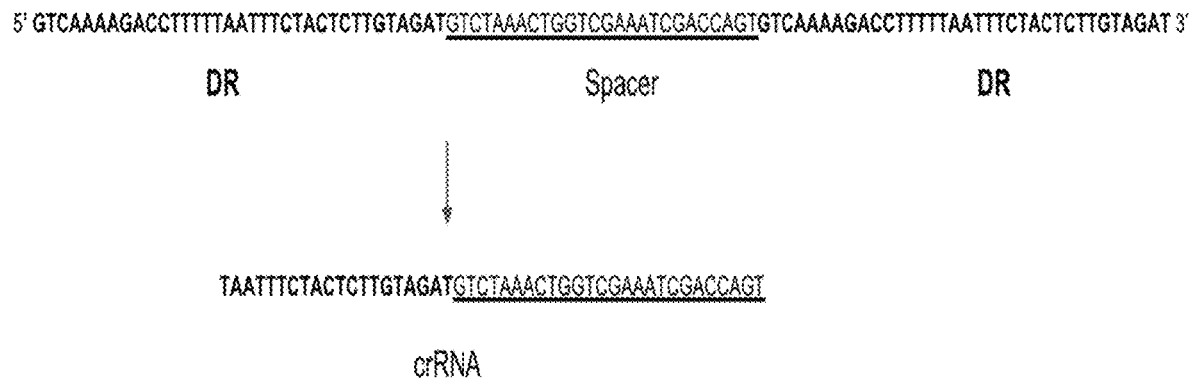
FIG. 5 illustrates a segment of the AsCpf1 CRISPR locus (SEQ ID NO: 243) as described in detail in Example 1, showing the arrangement in a CRISPR array of the AsCpf1 direct repeats ("DR", in bold font) (SEQ ID NO:176) flanking a spacer sequence ("spacer", in underlined font) (SEQ ID NO:177), and illustrating the predicted crRNA (SEQ ID NO:178) processing from this CRISPR array. The DR, spacer, and predicted crRNA sequences are provided as DNA equivalents.

FIG. 4 illustrates schematics of the *Acidaminococcus* sp. BV3L6 ("As") Cas12a ("AsCpf1") CRISPR locus and putative tracrRNA location; the schematics are shown with (upper figure) and without (lower figure) the Cas 1, Cas2, and Cas4 components of the locus. FIG. 5 illustrates a segment of the AsCpf1 CRISPR locus, showing the arrangement in a CRISPR array of the AsCpf1 direct repeats ("DR", in bold font) flanking a spacer sequence ("spacer", in underlined font), and illustrating the predicted crRNA processing from this CRISPR array. A putative AsCpf1 tracrRNA (72 nucleotides) is identified as having the RNA sequence of SEQ ID NO:6 encoded by the DNA sequence of SEQ ID NO:7. FIG. 6 illustrates the alignment of the reverse complement of the AsCpf1 direct repeat (DR) sequence, SEQ ID NO:8, with the AsCpf1 putative tracrRNA (SEQ ID NO:7), showing 51.4% identity between the two sequences.

Example 2

This example describes identification of restriction endonuclease recognition and cleavage sites in and adjacent to Cas12a tracrRNA sequences. It is understood that the recognition site to which restriction endonuclease binds may also be where cleavage occurs, or may be a short distance from where cleavage occurs.

Figure 7:
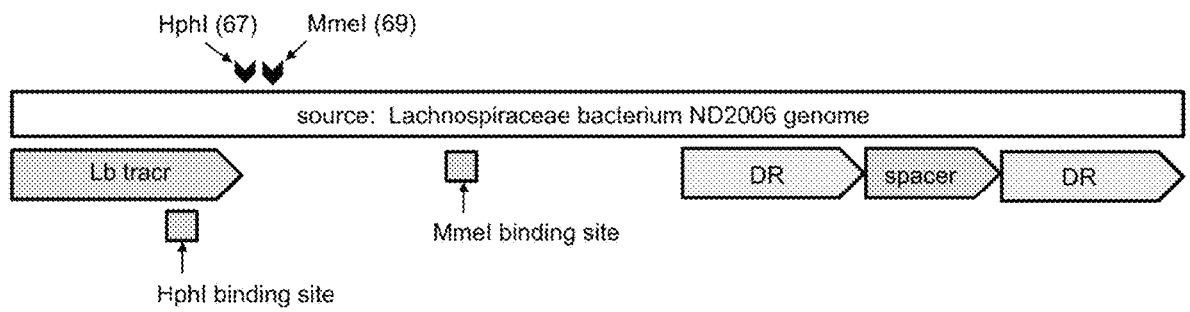
FIG. 7 schematically illustrates the position (not to scale) of some of the restriction endonuclease sites within the Lb Cas12a locus as described in detail in Example 2. Endonuclease recognition and binding sites are indicated by squares; the endonuclease cleavage sites are indicated by arrowheads. "DR" indicates a direct repeat.

Recognition and cleavage sites for commercially available restriction endonucleases are identified in the *Lachnospiraceae bacterium* ND2006 ("Lb") and *Acidaminococcus* sp. BV3L6 ("As") Cas12a loci, specifically in the region of the putative tracrRNA sequences described in Example 1. Table 1 lists restriction endonuclease sites located in or adjacent to (3' to) the DNA encoding the LbCpf1 putative tracrRNA 2 (65 nucleotides) (see Example 1); FIG. 7 schematically illustrates the position (not to scale) of some of the restriction endonuclease sites within the Lb Cas112a locus.

TABLE 1

| Restriction endonuclease name | Recognition pattern for endonuclease binding | Recognition pattern SEQ ID NO: | Endonuclease cleavage location, relative to the 5' terminus of the Lb tracrRNA 2 sequence |
|---|---|---|---|
| HphI | GGTGA(8/7) | 183 | 67 |
| AsuHPI | GGTGA(8/7) | 184 | 67 |
| MmeI | TCCRAC(20/18) | 185 | 69 |

Figure 8:
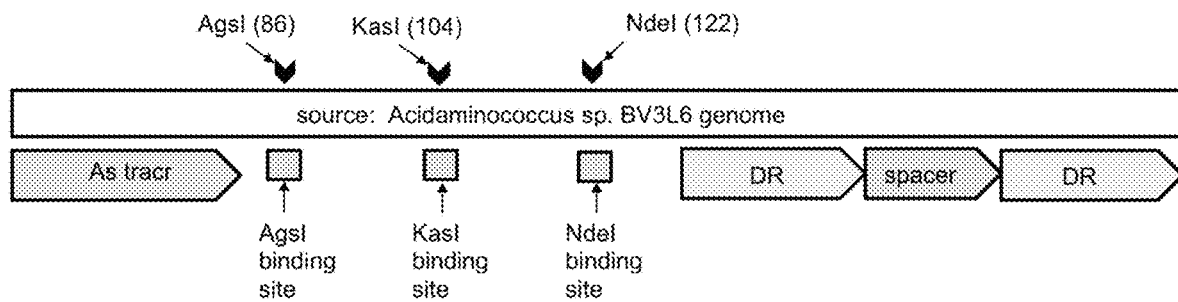
FIG. 8 schematically illustrates the position (not to scale) of some of the restriction endonuclease sites within the As Cas12a locus as described in detail in Example 2. Endonuclease recognition and binding sites are indicated by squares; the endonuclease cleavage sites are indicated by arrowheads. "DR" indicates a direct repeat.

Table 2 lists restriction endonuclease sites located in or adjacent to (3' to) the DNA encoding the AsCpf1 putative tracrRNA (72 nucleotides) (see Example 1); FIG. 8 schematically illustrates the position (not to scale) of some of the restriction endonuclease sites within the As Cas112a locus.

TABLE 2

| Restriction endonuclease name | Recognition pattern for endonuclease binding | Recognition pattern SEQ ID NO: | Endonuclease cleavage location, relative to the 5' terminus of the As tracrRNA sequence |
|---|---|---|---|
| AgsI | TTS^AA | 186 | 86 |
| MwoI, BstMWI, HpyF10VI | GCNNNNN^NNGC | 187 | 113 |
| Hin6I, HinP1I, HspAI | G^CGC | 188 | 105 |
| HhaI, AspLEI, BstHHI, CfoI | GCG^C | 189 | 107 |
| GlaI | GC^GC | 190 | 106 |
| AcyI, BsaHI, BssNI, BstACI, HinlI, Hsp92I | GR^CGYC | 191 | 105 |
| HaeII, BfoI, BstH2I | RGCGC^Y | 192 | 108 |
| NlaIV, BmiI, BspLI, PspN4I | GGN^NCC | 193 | 106 |
| KasI, SspDI | G^GCGCC | 194 | 104 |
| NarI, Mly113I | GG^CGCC | 195 | 105 |
| PluTI | GGCGC^C | 196 | 108 |
| DinI, EgeI, EheI, SfoI | GGC^GCC | 197 | 106 |
| AccB1I, BanI, BshNI, BspT107I | G^GYRCC | 198 | 104 |
| EcoT22I, Mph1103I, NsiI, Zsp2I | ATGCA^T | 199 | 118 |
| BsmI, Mva1269I, PctI | GAATGC (1/-1) | 200 | 116 |

TABLE 2-continued

| Restriction endonuclease name | Recognition pattern for endonuclease binding | Recognition pattern SEQ ID NO: | Endonuclease cleavage location, relative to the 5' terminus of the As tracrRNA sequence |
|---|---|---|---|
| MslI, RseI, SmiMI | CAYNN^NNRTG | 201 | 121 |
| TspDTI | ATGAA(11/9) | 202 | 109 |
| NdeI, FauNDI | CAATATG | 203 | 122 |

Example 3

This example illustrates non-limiting embodiments of the polynucleotides and ribonucleoproteins useful in carrying out methods of the invention.

Figure 9:
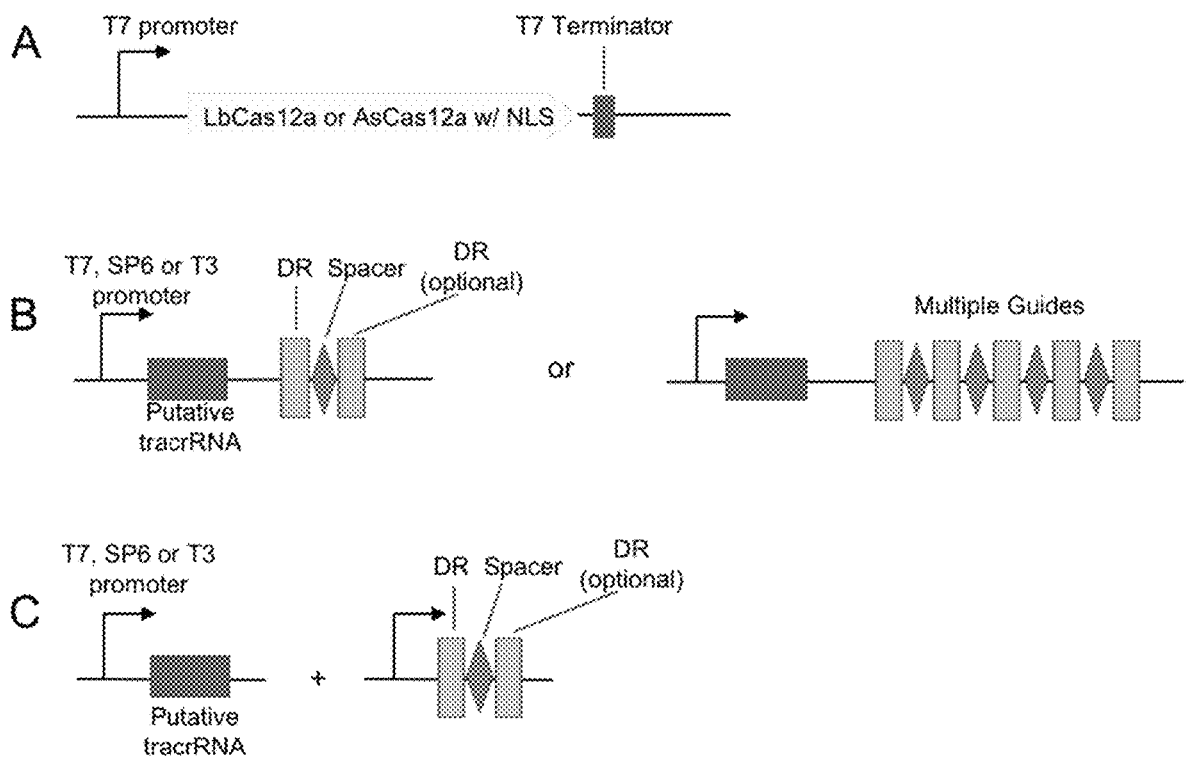
FIG. 9A schematically depicts an expression cassette for expressing a Cas12a nuclease, including a promoter, coding sequence for the Cas12a nuclease, and a terminator, as described in detail in Example 3.
FIG. 9B (left) schematically depicts a DNA expression system including: (a) DNA sequence for a first promoter; (b) operably linked and heterologous to the first promoter, a DNA encoding a first RNA molecule including a Cas12a tracrRNA or putative tracrRNA and including a restriction endonuclease cleavage site that is suitable for insertion of a sequence coding for a functional RNA moiety; and (c) operably linked and heterologous to the first promoter, a DNA encoding a Cas12a crRNA that includes a 3' extension capable of hybridizing with a segment of the first RNA molecule, as described in detail in Example 3.
FIG. 9C (left) schematically depicts a non-limiting example of a DNA expression system including: (a) DNA sequence for a first promoter; and (b) operably linked and heterologous to the first promoter, a DNA sequence encoding a first RNA molecule including a Cas12a tracrRNA or putative tracrRNA and including a restriction endonuclease cleavage site that is suitable for insertion of a sequence coding for a functional RNA moiety, as described in detail in Example 3.

FIG. 9A schematically depicts an expression cassette for expressing a Cas12a nuclease, including a promoter, coding sequence for the Cas12a nuclease, and a terminator. This non-limiting example illustrates a typical bacterial expression vector, wherein the promoter is a T7 promoter, the Cas12a nuclease is a fusion protein including LbCas12a or AsCas12a and at least one copy of a nuclear localization signal (NLS). This T7 expression system can be expressed and purified from *E. coli*. This or similar expression cassettes are useful, e.g., for expressing a Cas12a nuclease, with one or multiple copies of nuclear localization signal (NLS) for nuclear targeting located at the nuclease's N-terminus or C-terminus or both. The Cas12a nuclease may then be supplied as a protein and assembled with a guide RNA to form a ribonucleoprotein in vitro before delivery into cells.

FIG. 9B (left) schematically depicts a DNA expression system including: (a) DNA sequence for a first promoter; (b) operably linked and heterologous to the first promoter, a DNA sequence encoding a first RNA molecule including a Cas12a tracrRNA (here labelled "putative tracrRNA") and including a restriction endonuclease cleavage site (not specifically indicated) that is suitable for insertion of a sequence coding for a functional RNA moiety; and (c) operably linked and heterologous to the first promoter (and to the optional second promoter, if present), a DNA encoding a Cas12a crRNA (which includes a direct repeat, "DR" and a spacer sequence) that includes a 3' extension capable of hybridizing with a segment of the first RNA molecule. FIG. 9B (right) schematically depicts an alternative design wherein the DNA expression system includes a DNA encoding a Cas12a crRNA including multiple guide RNAs (i.e., multiple direct repeats and multiple spacer sequences), and including a 3' extension capable of hybridizing with a segment of the first RNA molecule. Optional elements that can be used in this system include a DNA sequence for a second promoter, which can be positioned between the DNA sequence encoding a first RNA molecule including a Cas12a tracrRNA and the DNA encoding a Cas12a crRNA; and a terminator, which can be positioned 3' to the DNA encoding a Cas12a crRNA. The 3'-most direct repeat is also optional. This or similar expression systems using e.g., a phage polymerase promoter (such as an SP6, T7, or T3 promoter) permit the tracrRNA and a guide RNA (the Cas12a crRNA) to be transcribed in vitro, together.

FIG. 9C (left) schematically depicts a non-limiting example of a DNA expression system including: (a) DNA sequence for a first promoter; and (b) operably linked and heterologous to the first promoter, a DNA sequence encoding a first RNA molecule including a Cas12a tracrRNA (here labelled "putative tracrRNA") and including a restriction endonuclease cleavage site (not specifically indicated) that is suitable for insertion of a sequence coding for a functional RNA moiety. (A similar expression system can also be used for expressing a DNA sequence encoding a functional RNA molecule including a Cas12a tracrRNA and a functional RNA moiety.) FIG. 9C (right) further schematically depicts an expression construct for expressing a guide RNA (here, a Cas12a crRNA including a direct repeat, "DR", and a spacer sequence); the 3'-most direct repeat is optional. These or similar expression systems using e.g., a phage polymerase promoter (such as an SP6, T7, or T3 promoter) permit the tracrRNA and a guide RNA (the Cas12a crRNA) to be transcribed in vitro, separately.

Figure 10:
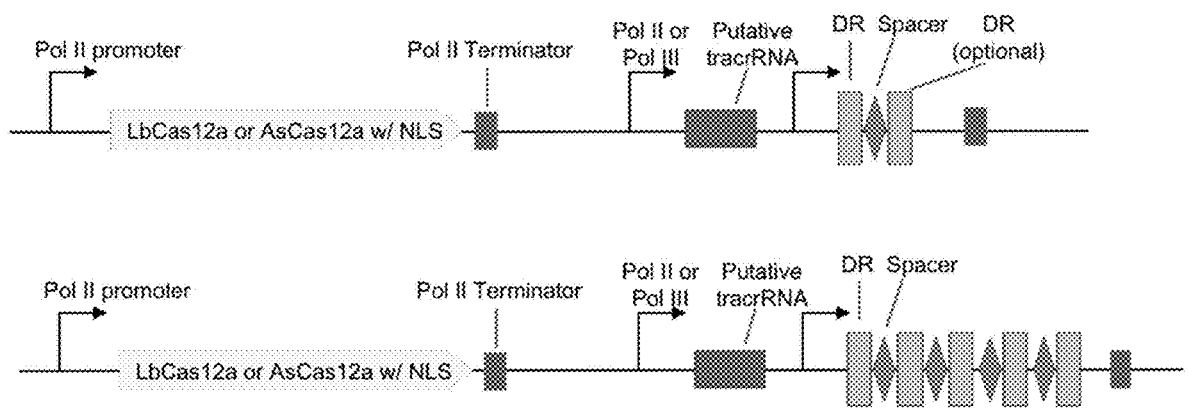
FIG. 10 (top) schematically depicts a DNA expression system, described in detail in Example 3, which includes: (a) DNA sequence for a first promoter; (b) operably linked and heterologous to the first promoter, DNA encoding a Cas12a nuclease; (c) a terminator; (d) a second promoter; (e) operably linked and heterologous to the second promoter, a DNA sequence encoding a functional RNA molecule including a Cas12a tracrRNA or putative tracrRNA and a functional RNA moiety; (f) an optional third promoter; (g) operably linked and heterologous to the second promoter (and to the optional third promoter, if present), a DNA encoding a guide RNA including a Cas12a crRNA that includes a 3' extension capable of hybridizing with a segment of the functional RNA molecule; and (h) a second terminator; the 3'-most direct repeat is optional.

FIG. 10 (top) schematically depicts a DNA expression system including: (a) DNA sequence for a first promoter (here, an RNA polymerase II promoter, such as a maize ubiquitin promoter); (b) operably linked and heterologous to the first promoter, DNA encoding a Cas12a nuclease (here, a fusion protein including LbCas12a or AsCas12a and at least one copy of a nuclear localization signal (NLS)); (c) a pol II terminator; (d) a second promoter (e.g., a pol II or pol III promoter, such as a rice U6 or U3 promoter); (e) operably linked and heterologous to the second promoter, a DNA sequence encoding a functional RNA molecule including a Cas12a tracrRNA (here labelled "putative tracrRNA") and a functional RNA moiety (not specifically indicated); (f) an optional third promoter; (g) operably linked and heterologous to the second promoter (and to the optional third promoter, if present), a DNA encoding a guide RNA including a Cas12a crRNA (which includes a direct repeat, "DR" and a spacer sequence) that includes a 3' extension capable of hybridizing with a segment of the functional RNA molecule; and (h) a second terminator; the 3'-most direct repeat is optional. FIG. 10 (bottom) schematically depicts a second DNA expression system similar to that shown in FIG. 10 (top), except that the guide RNA includes multiple guide RNAs (i.e., multiple direct repeats and multiple spacer sequences), and including a 3' extension capable of hybridizing with a segment of the first RNA molecule; the 3'-most direct repeat is optional. It will be apparent that multiple guide RNAs can alternatively be expressed under the control of multiple promoters. One of skill in the art will appreciate that similar constructs include many of the elements shown in FIG. 10 can be designed for expression of a tracrRNA and a crRNA under either one promoter or two promoters, and that promoters are selected for the type of organism (for example, a dicot plant rather than a monocot plant), tissue, or cell where the encoded nuclease and/or RNAs are to be expressed. Any of these DNA expression systems is conveniently provided on a single plasmid. While FIG. 10 depicts the component expression cassettes orientated in the same direction, it is understood that these can be orientated in opposite directions.

Example 4

This example describes a DNA expression system including: (a) DNA sequence for a first promoter; and (b) operably linked and heterologous to the first promoter, a DNA sequence encoding a functional RNA molecule including a Cas12a tracrRNA and a functional RNA moiety. This example illustrates employing a Cas12a tracrRNA as a scaffold or carrier for a functional RNA moiety (in this case, multiple copies of an aptamer capable of recruiting regulatory proteins as well as RNA for annealing to the crRNA 3' extension), allowing the functional RNA moiety to be incorporated into a Cas12a ribonucleoprotein complex. More specifically, this example illustrates a Cas12a ribonucleoprotein complex including a deactivated Cas12a nuclease, a guide RNA (a Cas12a crRNA having a 3' extension) targeting the promoter region of the maize (*Zea mays*) Lc gene, and a functional RNA molecule provided by integrating multiple copies of an MS2 aptamer as well as sequence for annealing to the crRNA 3' extension into a Cas12a tracr.

A ternary system is constructed containing a deactivated Cas12a nuclease, a guide RNA (a Cas12a crRNA having a 3' extension) targeting the promoter region of the maize (*Zea mays*) Lc gene, and a functional RNA molecule provided by integrating multiple copies of an MS2 aptamer and sequence for hybridizing to the crRNA 3' extension into a Cas12a tracr. FIG. 11 (top) schematically depicts construction of the DNA encoding the functional RNA molecule by cleavage at an HphI restriction endonuclease cleavage site (see Example 2 and Table 1) in or adjacent to a tracrRNA identified from the native *Lachnospiraceae bacterium* ND2006 CRISPR Cas12a locus (see Example 1), insertion of DNA encoding multiple copies of an MS2 aptamer as well as sequence for annealing to the crRNA 3' extension, and ligation to form the DNA encoding the functional RNA molecule, which can be complexed with the Cas12a nuclease to form the ribonucleoprotein depicted in FIG. 11 (bottom). A similar approach is useful for providing functional RNA molecules including a Cas12a tracrRNA and a functional RNA moiety, wherein the functional RNA moiety is one or more RNAs selected from the group consisting of (a) an RNA sequence for annealing to a donor polynucleotide; (b) an RNA sequence for annealing to the crRNA 3' extension; (c) a terminator sequence; (d) an RNA aptamer; (e) a ribozyme; (f) a detectable label; (g) a bar-coding sequence and (h) an RNA sequence forming at least partially double-stranded RNA, for example, RNA forming at least partially double-stranded RNA capable of silencing a gene (e.g., RNA that forms one or more stem-loops where the stem includes double-stranded RNA of at least about 18 base-pairs designed to silence a target gene, or RNA that has the secondary structure of a microRNA precursor and is processed to a mature microRNA designed to silence a target gene). For example, similar approaches are used for providing a functional RNA molecule that includes aptamers engineered to target endogenous proteins, such as transcriptional cofactors.

The DNA encoding the predicted tracrRNA identified from the native *Lachnospiraceae bacterium* ND2006 CRISPR Cas12a locus has the sequence

AATTGCAAATCTTTGAAATAATGCAGACTTAAATTTA

TAAATTCATGGAATAAGGTGATTTTATTGTGAAAAAA

TACTCGTATTTTGTTGGAAAAACATCTTTTTGTTGTA

TAATATGATGATATACGG (SEQ ID NO:9), where the tracrRNA nucleotides are shown in underlined font, the HphI recognition and binding site located within the tracrRNA is shown in bold font, and nucleotides of the native sequence located between the 3' end of the predicted tracrRNA and the 5' end of the CRISPR array are shown in plain font. The DNA encoding the MS2 aptamer stem-loops has the sequence GTTT-TAGAGCTAGGCCAACATGAGGATCACC-CATGTCTGCAGGGCCTAGCAAGTTAAAATAAG GCTAGTCCGTTATCAACTTGGCCAACATGAGGAT-CACCCATGTCTGCAGGGCCAAGTGGCACCG AGTCGGTGCTTTTT (SEQ ID NO:10). The deactivated LbCas12a nuclease is encoded by DNA having the sequence of SEQ ID NO:11, which is a D832A mutant of the wild-type Cas12a nuclease having NCBI reference sequence WP_051666128.1 (see www[dot]ncbi[dot]nlm[dot]nih[dot]gov/protein/WP_051666128.1/). In embodiments, the deactivated LbCas12a nuclease optionally includes additional modifications, for example, one or more copies of a nuclear localization signal (NLS), or an affinity tag for later purification of the nuclease, with, if needed, sequences permitting cleavage and removal of the affinity tag. The DNA encoding the Cas12a crRNA with the 3' extension has the sequence (SEQ ID NO: 12)
GTTTCAAAGATTAAATAATTTCTACTAAGTGTAGAT

TGGACAGAGCTCCAAGTGACCAAAACCGTATATCAT, where the direct repeat is shown in underlined font, the spacer targeting the promoter region of the maize (*Zea mays*) B104 Lc gene is shown in bold font, and the 3' extension is shown in plain font. The DNA targeted for editing is the maize (*Zea mays*) Lc gene, specifically the Zm-Lc promoter region having the sequence (SEQ ID NO: 13)
ATAGAGAGAGAAGAGGGGTCGTGTAGTAGTGCTTAA

ACTGTACATGAACAGCAGTAGTGTTACAGAAGCTA

AACTCAACCAGAGCTCCACCAAAGACAAAGAGGGT

CTACTTCCATCACCGTCTTGCTCGGTCACTTGGAG

CTCTGTCCATAAATTAAACCCATCGTGGCATATCT

GTAGGCATCTACCCCGTCTTCGTCGTCCGTTCCTC

ACTAGCTACCAAGAGGTCGCCATTATTGCCAACAT

AGAGTGTACGTGGATGTCTATATATATGCCTACTT

GCACCCATATGGCATAGGCGTTCGATCCCCTTAGC

GCGGAGGAGAGCTCCTCCGGTTCTTCTCTACCCTT

CGCATGGAAGTTCTTGCATTGCTTCGTTGCTTCTC

TAGTTTCTTCCTTCTACGTCTTTCCAGCATACGCA

TGCCCCTCGTCCGCCGGTTCACGAGGCATCGTCTG

ATGATCAGTAGATAATAAGCAATATAATACTGATC

TAGAATCGAGTTGTTGTACTCTTCGCAGATAGGTT

CGTTCCTTCACATAGAAGCGAGTACAGACTACAGA

CCACACAGTATCAGCTGGCACGAAACGAAAATGGT

TACTTGCAAATTGCATGCACGAGCTAGAATTATAT

TCTTCTAATCTTCTTCGTTGACTTTCTGGCTTCAG

CAGGCGCGTGAT, wherein the target sequence that corresponds to the Cas12a crRNA spacer sequence is indicated by bold, underlined font.

The DNA encoding the *Lachnospiraceae bacterium* ND2006 Cas12a tracrRNA sequence (SEQ ID NO:9) contained within a plasmid vector is cleaved with Hph1 or by another compatible restriction endonuclease (see Table 1, Example 2) and the DNA encoding the MS2 RNA-binding stem-loops (SEQ ID NO:10) is inserted by ligation to provide DNA encoding the functional RNA molecule (FIG. 11, top); alternatively, the DNA encoding the MS2 RNA-binding stem-loops (SEQ ID NO:10) is inserted into the DNA encoding the Cas12a tracrRNA through another molecular cloning method. This functional RNA molecule is transcribed in vitro and purified. A Cas12a crRNA (SEQ ID NO:12) containing a 3' extension of 10 ribonucleotides complementary to the 3' sequence of the Cas12a tracrRNA is similarly transcribed and purified. The two RNA molecules are mixed with deactivated LbCas12a nuclease (SEQ ID NO:11) in 10:1 molar excess in 50 millimolar HEPES buffer (300 millimolar NaCl, 1 millimolar MgCl2) at room temperature for 20 minutes to provide the ternary ribonucleoprotein for use in modifying the Lc promoter. Ternary RNPs are delivered to maize B104 protoplasts using PEG-mediated transformation. An MS2-tagged transcriptional regulator is co-transfected for multi-copy recruitment to the targeted locus, which is predicted to result in a change in expression of the maize Lc gene. An example of a suitable MS2-tagged transcriptional regulator sequence is an MS2-P65-HSF1 fusion of multiple transcriptional activators (P65 and HSF1) having the sequence of SEQ ID NO:14, which includes an MS2 region (nucleotides 1-390), a nuclear localization signal (NLS) (nucleotides 445-465), a PG5 region (nucleotides 481-1023), and an HSF1 region (nucleotides 1047-1419). In an alternative embodiment, the viral protein-derived transcriptional activator, VP64, with the sequence of SEQ ID NO:15, can be similarly tagged with the MS2 sequence and used to activate transcription of the maize Lc gene.

Example 5

This example illustrates non-limiting embodiments of DNA expression systems that include DNA sequence for a first promoter; and, operably linked and heterologous to the first promoter, a DNA sequence encoding either: (1) a first RNA molecule comprising a Cas12a tracrRNA and comprising a restriction endonuclease cleavage site that is suitable for insertion of a sequence coding for a functional RNA moiety, or (2) a functional RNA molecule comprising a Cas12a tracrRNA and a functional RNA moiety.

In an embodiment, the DNA expression system includes: (a) DNA sequence for a first promoter; and, operably linked and heterologous to the first promoter; (b) a DNA sequence encoding a first RNA molecule comprising a Cas12a tracrRNA and comprising a restriction endonuclease cleavage site that is suitable for insertion of a sequence coding for a functional RNA moiety; and (c) optionally, a terminator. In embodiments, the DNA expression system further comprises: (d) optionally, a DNA sequence for a second promoter; (e) operably linked and heterologous to the first promoter or the second promoter, a DNA encoding a Cas12a crRNA that comprises a 3' extension capable of hybridizing with a segment of the first RNA molecule; and (f) optionally, a terminator. In embodiments of such a DNA expression system, the Cas12a crRNA is capable of complexing with a Cas12a nuclease to form a Cas12a ribonucleoprotein complex. The DNA sequence encoding the first promoter and/or the optional second promoter and or the optional terminator(s) is selected according to the biological system of interest (e.g., for expression in a bacterial cell, a yeast cell, an animal cell, or a plant cell). Non-limiting examples of promoters useful in such DNA expression systems include Pol II promoters and Pol III promoters. Non-limiting examples of promoters useful in the DNA expression systems and engineered systems of this disclosure include promoters functional in prokaryotic cells (e.g., useful for in vitro transcription), such as, but not limited to, promoters from T7 bacteriophage (T7), T7 bacteriophage plus lac operators (T7lac), Sp6 bacteriophage (Sp6, used with SP6 RNA polymerase), arabinose metabolic operon (araBAD), *E. coli* tryptophan operator (trp), lac operon (lac), bacteriophage lambda (pL), and a hybrid promoter of lac and trp (Ptac). Non-limiting examples of promoters useful especially in animal cells include promoters from β-actin (ACTB), cytomegalovirus (CMV), elongation factor-1α, (EF1α), phosphoglycerate kinase (PGK1), ubiquitin C (UbC), herpes simplex virus thymidine kinase (HSV-1 TK), early and late simian vacuolating virus 40 (SV40), long terminal repeats (LTRs) from retrovirus, mouse metallothionein-I, *Drosophila* actin 5c, baculovirus polyhedron, yeast transcription elongation factor (TEF1), alcohol dehydrogenase I (ADH1), glyceraldehyde 3-phosphate dehydrogenase (GAPDH), human polymerase III RNA promoter (H1), human U6 small nuclear promoter (U6), an inducible tetracycline response element promoter, and a CAG hybrid (containing a CMV enhancer, chicken beta actin promoter, and rabbit beta-globin splice acceptor); many other promoters useful in animals, including in humans (e.g., for gene therapeutic applications) are available in the art, see, e.g., Zheng and Baum (2008) *Methods Mol. Biol.,* 434:205-219 (available at doi:10.1007/978-1-60327-248-3_13). Non-limiting examples of promoters useful in such DNA expression systems especially in plant cells include a nopaline synthase (Nos) promoter and a ubiquitin promoter; specific examples include a promoter selected from the group consisting of a TaU3 promoter (SEQ ID NO:16), a Nos promoter (SEQ ID NO:17), a ZmUBI1 promoter (SEQ ID NO:18), and a SlUBI10 promoter (SEQ ID NO:19). Further non-limiting examples of promoters especially useful in plant cells include SEQ ID NOs:20-71; see Table 3. Specific embodiments include a DNA expression system wherein the first promoter has a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter, and the Cas12a tracrRNA has the sequence of SEQ ID NOs:1, 3, 6, 139-146, 149-169, 223-240, and 241. Specific embodiments include a DNA expression system having the optional second promoter, wherein the second promoter has a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter. In embodiments, the first promoter and optional second promoter have different sequences; in other embodiments, the first promoter and optional second promoter have identical sequences. In embodiments, the Cas12a crRNA is capable of complexing with a Cas12a nuclease to form a Cas12a ribonucleoprotein complex; in embodiments, the Cas12a nuclease is (a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas creviorcanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A.

In embodiments, the DNA expression system includes: (a) DNA sequence for a first promoter wherein the first promoter has a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter; and, operably linked and heterologous to the first promoter; (b) a DNA sequence encoding a first RNA molecule comprising a Cas12a tracrRNA, wherein the Cas12a tracrRNA has a sequence that is selected from the group consisting of SEQ ID NOs:1, 3, 6, 139-146, 149-169, 223-240, and 241 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter, and that comprises a restriction endonuclease cleavage site that is suitable for insertion of a sequence coding for a functional RNA moiety; and (c) optionally, a terminator, preferably a terminator functional in a eukaryotic cell; in embodiments, the DNA expression system further comprises: (d) optionally, a DNA sequence for a second promoter, e.g., a promoter having a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter; (e) operably linked and heterologous to the first promoter or the second promoter, a DNA encoding a Cas12a crRNA that comprises a 3' extension capable of hybridizing with a segment of the first RNA molecule and that is capable of complexing with a Cas12a nuclease to form a Cas12a ribonucleoprotein complex, wherein the Cas12a nuclease is (a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, *Candidatus* Methanoplasma *termitum*, *Eubacterium eligens*, *Moraxella* bovoculi 237, *Leptospira inadai*, *Lachnospiraceae bacterium* ND2006, *Porphyromonas crevioricanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1 107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A; and (f) optionally, a terminator.

In another embodiment, the DNA expression system includes: (a) DNA sequence for a first promoter; and, operably linked and heterologous to the first promoter, (b) a DNA sequence encoding a functional RNA molecule comprising a Cas12a tracrRNA and a functional RNA moiety. In embodiments, the DNA expression system further comprises: (c) optionally, a DNA sequence for a second promoter; (d) operably linked and heterologous to the first promoter or the second promoter, a DNA encoding a Cas12a crRNA that comprises a 3' extension capable of hybridizing with a segment of the functional RNA molecule; and (e) optionally, a terminator. In embodiments of such a DNA expression system, the Cas12a crRNA is capable of complexing with a Cas12a nuclease to form a Cas12a ribonucleoprotein complex. The DNA sequence encoding the first promoter is selected according to the biological system of interest (e.g., for expression in a bacterial cell, a yeast cell, an animal cell, or a plant cell). Non-limiting examples of promoters useful in such DNA expression systems include a nopaline synthase (Nos) promoter and a ubiquitin promoter; specific examples include a promoter selected from the group consisting of a TaU3 promoter (SEQ ID NO:16), a Nos promoter (SEQ ID NO:17), a ZmUBI1 promoter (SEQ ID NO:18), and a SlUBI10 promoter (SEQ ID NO:19). Specific embodiments include a DNA expression system wherein the first promoter has a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter, and the functional RNA molecule includes a Cas12a tracrRNA that has the sequence of SEQ ID NO:3. Specific embodiments include a DNA expression system wherein the Cas12a crRNA is capable of complexing with a Cas12a nuclease to form a Cas12a ribonucleoprotein complex, wherein the first promoter has a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter and wherein the Cas12a nuclease is (a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A; in some embodiments of such DNA expression systems, the Cas12a tracrRNA has the sequence of SEQ ID NOs:1, 3, 6, 139-146, 149-169, 223-240, and 241.

Embodiments of these various DNA expression systems further include additional expression elements, e.g., expression enhancing elements ("enhancers"), 3' untranslated region elements such as terminators or polyadenylation elements, and introns. The DNA sequences encoding the first promoter, optional second promoter, optional terminator, and any other expression element are generally selected according to the biological system of interest (e.g., for expression in a bacterial cell, a yeast cell, an animal cell, or a plant cell). Terminators useful in DNA expression systems and engineered systems of this disclosure include terminators having a sequence selected from the group consisting of SEQ ID NOs:72-100 or comprise a U6 poly-T terminator, an SV40 terminator, an hGH terminator, a BGH terminator, an rbGlob terminator, or a synthetic terminator functional in a eukaryotic cell. Other expression elements useful in DNA expression systems and engineered systems of this disclosure include expression elements having a sequence selected from the group consisting of SEQ ID NOs:101-106.

Promoters useful in plant cells include promoters especially suited to monocot plants and promoters especially suited to dicot plants. Non-limiting examples of these various expression elements are provided in Table 3 and are useful for heterologous expression of Cas2a tracrRNAs, such as a tracrRNA having an RNA sequence selected from the group consisting of SEQ ID NOs:1, 3, 6, 1392-146, 149-169, 223-240, and 241 or the Cas2a tracrRNA sequences disclosed in U.S. Pat. No. 9,790,490 (incorporated herein by reference).

TABLE 3

| Designation | Source | Source ID | Application | Type | SEQ ID NO: |
|---|---|---|---|---|---|
| prAtUbi10 | *Arabidopsis thaliana* | AT4G05320.2 | Pol II promoter | dicot | 20 |
| prGmUBI8 | Glycine max | Glyma10g051100 | Pol II promoter | dicot | 21 |
| prGmUBI1 | Glycine max | Glyma10g251900 | Pol II promoter | dicot | 22 |
| prGmUBI9 | Glycine max | Glyma13g138600 | Pol II promoter | dicot | 23 |
| prGmUBI4 | Glycine max | Glyma13g176100 | Pol II promoter | dicot | 24 |
| prGmUBI7 | Glycine max | Glyma17g042100 | Pol II promoter | dicot | 25 |
| enTCUP2 | tobacco | JX155386.1 | Pol II promoter | dicot | 26 |
| prSlUbi10 | *Solanum lycopersicum* | LOC101258282 | Pol II promoter | dicot | 27 |
| prWpUbi10 | White pear | LOC103948134 | Pol II promoter | dicot | 28 |
| prBvUbi10 | Sugar beet | LOC104907074 | Pol II promoter | dicot | 29 |
| prRsUbi10 | Radish | LOC108826774 | Pol II promoter | dicot | 30 |
| prIlUbi10 | Japanese morning glory | LOC109190585 | Pol II promoter | dicot | 31 |
| prCuUbi10 | *Cucurbita* | LOC111802502 | Pol II promoter | dicot | 32 |
| prHaUBI | *Helianthus annuus* | OTG28215 | Pol II promoter | dicot | 33 |
| prLAT52 | tomato | X15855 | Pol II promoter | dicot | 34 |
| prHaUbi1 | *Helianthus annuus* | X57005.1 | Pol II promoter | dicot | 35 |
| prPcUbi4 | Parsley | X64345.1 | Pol II promoter | dicot | 36 |
| SlU6-2 | tomato | | Pol III promoter | dicot | 37 |

TABLE 3-continued

| Designation | Source | Source ID | Application | Type | SEQ ID NO: |
|---|---|---|---|---|---|
| MtU6.6 | Medicago truncatula | | Pol III promoter | dicot | 38 |
| GmU6-9.1 | Glycine max | | Pol III promoter | dicot | 39 |
| AtU6 | Arabidopsis thaliana | | Pol III promoter | dicot | 40 |
| GmU6-10 | Glycine max | | Pol III promoter | dicot | 41 |
| TC-AtU6 | Arabidopsis thaliana | | Pol III promoter | dicot | 42 |
| At7SL | Arabidopsis thaliana | | Pol III promoter | dicot | 43 |
| ZmKN1 | Zea mays | AY312169.1 | Pol II promoter | monocot | 44 |
| prOsACT-B | Oryza sativa | CP018159 | Pol II promoter | monocot | 45 |
| prOsACT-A | Oryza sativa | EU155408.1 | Pol II promoter | monocot | 46 |
| PvUBI1 | Panicum virgatum | HM209467.1 | Pol II promoter | monocot | 47 |
| prOsUbi2 | Oryza sativa | LOC_Os02g06640 | Pol II promoter | monocot | 48 |
| prOsUbi1 | Oryza sativa | LOC_Os06g46770 | Pol II promoter | monocot | 49 |
| prAtaUbi1 | Aegilops tauschii | LOC109747268 | Pol II promoter | monocot | 50 |
| prPhUbi1 | Panicum hallii | LOC112888620 | Pol II promoter | monocot | 51 |
| prZmADP1 | Zea mays | LOC542430 | Pol II promoter | monocot | 52 |
| prZmEF1alpha | Zea mays | LOC542581 | Pol II promoter | monocot | 53 |
| prZmADP2 | Zea mays | LOC542584 | Pol II promoter | monocot | 54 |
| prZmUBI1 | Zea mays | S94464 | Pol II promoter | monocot | 55 |
| prLPT2-A | Hordeum vulgare | X69793 | Pol II promoter | monocot | 56 |
| prLPT2-B | Hordeum vulgare | X69793 | Pol II promoter | monocot | 57 |
| prZmFluory2 | Zea mays | ZEAMMB73_Zm00001d049243 | Pol II promoter | monocot | 58 |
| pZMU6-C1_Short | Zea mays | maize | Pol III promoter | monocot | 59 |
| pOsU6.1 | Oryza sativa | rice | Pol III promoter | monocot | 60 |
| pOsU6.2 | Oryza sativa | rice | Pol III promoter | monocot | 61 |
| pOsU6.1_short | Oryza sativa | rice | Pol III promoter | monocot | 62 |
| pOsU6.2_short | Oryza sativa | rice | Pol III promoter | monocot | 63 |
| OsU6 | Oryza sativa | | Pol III promoter | monocot | 64 |
| TaU3 | wheat | | Pol III promoter | monocot | 65 |
| prM24 | Mirabilis mosaic virus | AF454635.1 | Pol II promoter | dicot or monocot | 66 |
| pr35S | Cauliflower mosaic virus | V00140.1 | Pol II promoter | dicot or monocot | 67 |
| prFMV | figwort mosaic virus | X06166.1 | Pol II promoter | dicot or monocot | 68 |
| prFMV 34S-1/2x | figwort mosaic virus | X16673.1 | Pol II promoter | dicot or monocot | 69 |
| prNOS | Agrobacterium | | Pol II promoter | dicot or monocot | 70 |
| prOCS | Agrobacterium | | Pol II promoter | dicot or monocot | 71 |
| tAtUbi10 | Arabidopsis thaliana | AT4G05320.2 | Pol II terminator | dicot | 72 |
| tAtADH | Arabidopsis thaliana | AY536888 | Pol II terminator | dicot | 73 |
| tNtExt | Nicotiana tabacum | D13951 | Pol II terminator | dicot | 74 |
| tHSP 18.2 | Arabidopsis thaliana | GeneID:836093 | Pol II terminator | dicot | 75 |
| tGmUbi1 | Glycine max | Glyma10g251900 | Pol II terminator | dicot | 76 |
| tSlUbi10 | Solanum lycopersicum | LOC101258282 | Pol II terminator | dicot | 77 |
| tWpUbi10 | White pear | LOC103948134 | Pol II terminator | dicot | 78 |
| tBvUbi10 | Sugar beet | LOC104907074 | Pol II terminator | dicot | 79 |
| tRsUbi10 | Radish | LOC108826774 | Pol II terminator | dicot | 80 |
| tIlUbi10 | Japanese morning glory | LOC109190585 | Pol II terminator | dicot | 81 |
| tCuUbi10 | Cucurbita | LOC111802502 | Pol II terminator | dicot | 82 |
| tHaUBI | Helianthus annuus | OTG28215 | Pol II terminator | dicot | 83 |
| tpea E9 | Pisum sativum | X00806 | Pol II terminator | dicot | 84 |
| tpea 3A | Pisum sativum | X04333.1 | Pol II terminator | dicot | 85 |
| tHaUbi1 | Helianthus annuus | X57005.1 | Pol II terminator | dicot | 86 |
| tZmKN1 | Zea mays | AY312169.1 | Pol II terminator | monocot | 87 |
| tOsAct1 | Oryza sativa | CP018159 | Pol II terminator | monocot | 88 |
| tOsUbi2 | Oryza sativa | LOC_Os02g06640 | Pol II terminator | monocot | 89 |
| tOsUbi1 | Oryza sativa | LOC_Os06g46770 | Pol II terminator | monocot | 90 |
| tAtaUbi1 | Aegilops tauschii | LOC109747268 | Pol II terminator | monocot | 91 |

TABLE 3-continued

| Designation | Source | Source ID | Application | Type | SEQ ID NO: |
|---|---|---|---|---|---|
| tPhUbi1 | *Panicum hallii* | LOC112888620 | Pol II terminator | monocot | 92 |
| tZmADP1 | *Zea mays* | LOC542430 | Pol II terminator | monocot | 93 |
| tZmEF1alpha | *Zea mays* | LOC542581 | Pol II terminator | monocot | 94 |
| tZmADP2 | *Zea mays* | LOC542584 | Pol II terminator | monocot | 95 |
| tZmUbi1 | *Zea mays* | S94464 | Pol II terminator | monocot | 96 |
| tLPT2 | *Hordeum vulgare* | X69793 | Pol II terminator | monocot | 97 |
| tZmFluory2 | *Zea mays* | ZEAMMB73_Zm00001d049243 | Pol II terminator | monocot | 98 |
| t35S | Cauliflower mosaic virus | V00140.1 | Pol II terminator | dicot or monocot | 99 |
| tNOS | Agrobacterium | | Pol II terminator | dicot or monocot | 100 |
| TMV translational enhancer | tobacco mosaic virus | | enhancer | dicot | 101 |
| FMV 34S double enhancer | figwort mosaic virus | | enhancer | dicot or monocot | 102 |
| FMV34S/CaMV35S enhancer | figwort and cauliflower mosaic virus/synthetic | | enhancer | dicot or monocot | 103 |
| iGmIDH1 | Glycine max | Gene ID: 606295 | intron | dicot | 104 |
| iZmPEPC | *Zea mays* | LOC542372 | intron | monocot | 105 |
| MALAT1 | mouse | | 3' end (triple helix) | dicot or monocot | 106 |

Example 6

This example illustrates non-limiting embodiments of Cas12a nucleases and their corresponding tracrRNA sequences. Table 4 provides the protein sequences of several Cas112a nucleases and the RNA sequence of each nuclease's associated tracrRNA. Table 4 further identifies for each tracrRNA one or more native restriction endonuclease cleavage sites that are suitable, e.g., for insertion of a sequence coding for a functional RNA moiety.

TABLE 4

| Species | Protein Accession Number | Protein SEQ ID NO: | tracrRNA SEQ ID NO: | Restriction sites within DNA between tracrRNA and CRISPR array | Restriction sites within DNA encoding the tracrRNA | Putative PAM |
|---|---|---|---|---|---|---|
| Uncultured *Clostridium* sp. isolate 2789STDY5608795 | SCH45297.1 | 107 | 139 | SgeI, HpyCH4III, MfeI, SspI | DraI | 5' TTTV |
| Uncultured bacterium (gcode 4) ACD_3C00058, whole genome shotgun sequence | EKE28449.1 | 108 | 140 | AvrII | HphI, HpyAV, | 5' TTTV |
| *Thiomicrospira* sp. XS5ZB100000 | WP_068647445.1 | 109 | 141 | AjuI, BceAI, HpyCH4III | BseMII, BspHI | 5' TTTV |
| *Flavobacterium branchiophilum* FL-15 | WP_014085038.1 | 110 | 142 | BtsI, TspRI, FspEI | HindIII, DraI | 5' TTTV |
| *Moraxella bovoculi* strain 57922 | AKG14689.1 | 111 | 143 | BslI | DraI, ApoI | 5' TTV |
| *Candidatus Roizmanbacteria* bacterium GW2011_GWA2_37_7 US54_C0016 | KKQ38174.1 | 112 | 144 | DdeI, HgaI, Hpy188I, DrdI, | BbsI, MboII | 5' TTTV |
| *Pseudobutyrivibrio xylanivorans* | SCZ76797.1 | 113 | 145 | TspRI, FspEI | TspDTI, SmoI, BsuI, BpuEI | 5' TTTV |
| *Prevotella bryantii* B14 | SER03894.1 | 114 | 146 | TatI, ScaI | EcoRV, PsiI, | 5' TTTV |
| *Smithella* sp. SCADC | KFO67988.1 | 115 | 147 | PspGI, BstNI, | HhaI | 5' TTTV |
| *Smithella* sp. SCADC | KFO67988.1 | 115 | 148 | EcoRII | CfoI | 5' TTTV |
| Bacteroidetes bacterium GWF2_33_38 | OFY19591.1 | 116 | 149 | CviQI | DraI | 5' TTTV |

TABLE 4-continued

| Species | Protein Accession Number | Protein SEQ ID NO: | tracrRNA SEQ ID NO: | Restriction sites within DNA between tracrRNA and CRISPR array | Restriction sites within DNA encoding the tracrRNA | Putative PAM |
|---|---|---|---|---|---|---|
| Candidatus Peribacteria bacterium RIFCSPLOWO2 | OGJ66851.1 | 117 | 150 | AlwNI, EarI, AcuI | EcoRV, NdeI | 5' TTTV |
| Nitrospinae bacterium RIFCSPLOWO2 | OGW03971.1 | 118 | 151 | BstAPI, BsmAI | HaeII | 5' TTTV |
| Candidatus Ryanbacteria bacterium RIFCSPHIGHO2 | OGZ45678.1 | 119 | 152 | BccI, MmeI, Hpy188I | FauI, HpyAV, BseNI | 5' TTTV |
| Candidatus Wildermuthbacteria bacterium RIFCSPHIGHO2 | OHA63117.1 | 120 | 153 | MmeI, BglII, Hpy188I | PsiI, Eco57I, | 5' TTTV |
| Firmicutes bacterium CAG_194_44_15 | OLA30477.1 | 121 | 154 | BsgI | MaeII | 5' TTTV |
| Candidatus Gottesmanbacteria bacterium CG1_02_37_22 | OIO15737.1 | 122 | 155 | FauI, BbvI | PsiI, SspI, BfrI | 5' TTTV |
| Candidatus Gracilibacteria bacterium CG1_02_38_174 | OIO75780.1 | 123 | 156 | BaeI | BseMII, BbsI | 5' TTTV |
| Butyrivibrio fibrisolvens MD2001 | WP_027216152.1 | 124 | 157 | BceAI | PsiI, HphI | 5' TTTV |
| Sneathia amnii strain SN35 | WP_084710347.1 | 125 | 158 | BccI, BspPI | SspI, DraI | 5' TTTV |
| Coprococcus eutactus strain 2789STDY5608843 | WP_082431329.1 | 126 | 159 | PsiI, ApaLI | TspDTI, MaeIII | 5' TTTV |
| Lachnospira pectinoschiza strain 2789STDY5834886 | WP_055306762.1 | 127 | 160 | MseI | BccI, SspI, DraI | 5' TTTV |
| Bacteroidetes oral taxon 274 str. F0058 | WP_009217842.1 | 128 | 161 | BsrGI, AseI, BsrDI | TspDTI, ApoI | 5' TTN |
| Arcobacter butzleri L348 isolate CHRB125 | WP_052943011.1 | 129 | 162 | MseI | SspI, HindIII | 5' TTTV |
| Bacteroidales bacterium KA00251 | WP_066040075.1 | 130 | 163 | BccI, BstXI | EarI | 5' TTTV |
| Acidaminococcus massiliensis strain Marseille-P2828 | WP_075579848.1 | 131 | 164 | BccI, Bpu10I | PleI, MlyI | 5' TTTV |
| Helcococcus kunzii | WP_005398606.1 | 132 | 165 | AfeI | EcoRV, NsiI, BsrDI | 5'-YYN |
| Agathobacter rectalis strain 2789STDY5834884 | CUO57667.1 | 133 | 166 | ApoI | PsiI | 5'TTN |
| Acidaminococcus sp. BV3L6 | WP_021736722.1 | 134 | 167 | KasI, NdeI | MmeI, Bpu10I, BspMI | 5' TTTV |
| Lachnospiraceae bacterium ND2006 | WP_051666128.1 | 135 | 168 | MmeI, HphI | PsiI, AanI | 5' TTTV |
| Francisella tularensis subsp. novicida U112 | ABK90267.1 | 136 | 169 | | DraI | 5' TTTV |
| Omnitrophica WOR_2 bacterium GWF2_38_59 | OGX23684.1 | 137 | 170 | ApoI | LweI | 5' TTTV |
| Candidatus Roizmanbacteria bacterium GW2011_GWA2_37_7 US54_C0016 | KKQ38176.1 | 138 | 171 | CseI | BbsI | 5' TTTV |
| Butyrivibrio hungatei strain MB2003 plasmid pNP144, complete sequence | AOZ97886.1 | 204 | 223 | TaaI, CviAII, SspI, HpyCH4V, PpsI | AgsI, HpyCH4V, MnlI, TspGWI, HpyCH4IV | TTTV |

TABLE 4-continued

| Species | Protein Accession Number | Protein SEQ ID NO: | tracrRNA SEQ ID NO: | Restriction sites within DNA between tracrRNA and CRISPR array | Restriction sites within DNA encoding the tracrRNA | Putative PAM |
|---|---|---|---|---|---|---|
| *Butyrivibrio hungatei* strain MB2003 plasmid pNP144, complete sequence | AOZ97886.2 | 205 | 224 | MnlI | AluI, TasI, RsaI | TTTV |
| *Butyrivibrio hungatei* strain MB2003 plasmid pNP144, complete sequence | AOZ97886.3 | 206 | 225 | HpyCH4V, Sse9I, BccI, AlwI, Sau3AI, MnlI, AgsI | AgsI, TasI, SspI, DraI | TTTV |
| *Butyrivibrio hungatei* strain MB2003 plasmid pNP144, complete sequence | AOZ97886.4 | 207 | 226 | | TaaI | TTTV |
| [Eubacterium] eligens ATCC 27750 chromosome, complete genome | ACR72412.1 | 208 | 227 | AgsI | CviAII, DraI, AgsI, TspDTI | TTTV |
| *Candidatus* Methanoplasma termitum strain MpT1, complete genome | AIZ56868.1 | 209 | 228 | Sse9I, Bsp1407I, RsaI, AciI, Hpy188I | CviAII, PfeI, BmsI, BsiSI, TasI, AgsI | TTTV |
| *Moraxella bovoculi* strain 57922 chromosome, complete genome | AKG14689.1 | 210 | 229 | MseI, AflI | AluI, Cac8I, HpyCH4V, HpyF3I, MseI, FatI | TTTV |
| *Francisella hispaniensis* FSC454, complete genome | WP_003040289.1 | 211 | 230 | | DdeI, DraI, TaaI | TTTV |
| *Saccharobesus litoralis* strain CCB-QB4 chromosome, complete genome | AWB68459.1 | 212 | 231 | | TspDTI, BstHHI, AciI | TTTV |
| *Treponema rectale* strain CHPA chromosome, complete genome | QOS40006.1 | 213 | 232 | ScaI, Bsp1407I | DdeI, BseNI, TspDTI, TauI | TTTV |
| *Ruminococcus bovis* strain JE7A12 chromosome, complete genome | QCT07655.1 | 214 | 233 | MseI | DdeI, AgsI, MboII, MfeI | TTTV |
| *Pseudobutyrivibrio xylanivorans* strain MA3014 chromosome 1, complete sequence | QFJ54394.1 | 215 | 234 | | Hpy188I, BstYI, CviAII, HpyCH4V, AgsI | TTTV |
| *Helcococcus kunzii* strain H13 chromosome | QUY65005.1 | 216 | 235 | AgsI, AluI | EcoRV, TspDTI, Bse3DI, Hin6I | TTTV |
| *Lachnospira eligens* strain FDAARGOS_1570 chromosome, complete genome | UEA98518.1 | 217 | 236 | | HpyCH4V, CviAII, Sse9I, AgsI, TspDTI | TTTV |
| candidate division WWE3 bacterium CG22_combo_CG10-13_8_21_14_all_39_12 | PIP56079.1 | 218 | 237 | BstHHI, MboII, Sse9I, MnlI | SsiI, PsiI, AsuHPI, MnlI, MaeIII, DdeI, MseI | TTTV |
| Patescibacteria group bacterium | MBU1900830.1 | 219 | 238 | TspDTI, MfeI, SspI, MseI, BsaJI, MboII, BseJI, MaeI | HpyF10VI, BclI | TTTV |
| *Prevotella* sp. P4-98 | OYP46450.1 | 220 | 239 | CviAII, AgsI, Cac8I, BspFNI | RsaI, Sse9I, AanI, MwoI | TTTV |

TABLE 4-continued

| Species | Protein Accession Number | Protein SEQ ID NO: | tracrRNA SEQ ID NO: | Restriction sites within DNA between tracrRNA and CRISPR array | Restriction sites within DNA encoding the tracrRNA | Putative PAM |
|---|---|---|---|---|---|---|
| Unknown | CasJ | 221 | 240 | | MfeI, Sse9I, HpyCH4V, MaeI, MseI, SspI | TTTV |
| Unknown | CasJ | 222 | 241 | | SspI, MseI, BssECI, HpyCH4V, MunI, Sse9I | TTTV |

Various DNA expression systems disclosed herein are useful for the expression of these Cas12a tracrRNA sequences. Embodiments include a DNA expression system including (a) DNA sequence for a first promoter; and (b) operably linked and heterologous to the first promoter a DNA sequence encoding a first RNA molecule including a Cas12a tracrRNA and including a restriction endonuclease cleavage site (native or engineered) that is suitable for insertion of a sequence coding for a functional RNA moiety. The functional RNA moiety is characterized by one or more functions. Embodiments of the RNA moiety include RNA sequences for annealing to one or more polynucleotides, RNA sequences that provide structures for binding to other molecules (including proteins or small molecule ligands) or that are catalytically active, or RNA sequences that serve as directly or indirectly detectable labels. Thus, non-limiting embodiments include a DNA expression system including (a) DNA sequence for a first promoter; and (b) operably linked and heterologous to the first promoter a DNA sequence encoding a first RNA molecule including a Cas12a tracrRNA and including a restriction endonuclease cleavage site (native or engineered) that is suitable for insertion of a sequence coding for a functional RNA moiety, wherein the Cas12a tracrRNA has an RNA sequence selected from the group consisting of SEQ ID NOs:1, 3, 6, 139-146, 149-169, 223-240, and 241; in some embodiments, the first promoter includes a DNA sequence selected from the group consisting of SEQ ID NOs:16-71. In other embodiments, the Cas12a tracrRNA is selected from the Cas12a tracrRNA sequences disclosed in U.S. Pat. No. 9,790,490 (incorporated herein by reference).

In other embodiments, the DNA expression system includes: (a) DNA sequence for a first promoter; (b) operably linked and heterologous to the first promoter a DNA sequence encoding a first RNA molecule including a Cas12a tracrRNA and including a restriction endonuclease cleavage site (native or engineered) that is suitable for insertion of a sequence coding for a functional RNA moiety; (c) optionally, a DNA sequence for a second promoter; (d) operably linked and heterologous to the first promoter or the second promoter, a DNA encoding a Cas12a crRNA that includes a 3' extension capable of hybridizing with a segment of the first RNA molecule; and (e) optionally, a terminator. In non-limiting embodiments, the Cas12a tracrRNA has an RNA sequence selected from the group consisting of SEQ ID NOs:1, 3, 6, 139-146, 149-169, 223-240, and 241; in some embodiments, the first promoter includes a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter; in some embodiments, the optional second promoter includes a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter; in some embodiments, the optional terminator includes a DNA sequence selected from the group consisting of SEQ ID NOs:72-100. In embodiments, the first promoter and the DNA encoding the first RNA molecule, and the DNA encoding a Cas12a crRNA that includes a 3' extension are contained in a single construct, and in other embodiments, the first promoter and the DNA encoding the first RNA molecule are contained in a first construct, and the second promoter and the DNA encoding a Cas12a crRNA that includes a 3' extension are contained in a second construct. Where the DNA expression system is provided in a first construct and a second construct, these can be provided in a single vector or in separate vectors. In some embodiments wherein the DNA expression system includes DNA encoding a Cas12a crRNA, the first promoter drives expression of both the DNA encoding the first RNA molecule and the DNA encoding the Cas12a crRNA. In some embodiments, the Cas12a tracrRNA further includes a 5' extension. In many embodiments of the DNA expression system, the Cas12a crRNA is capable of complexing with a Cas12a nuclease to form a Cas12a ribonucleoprotein complex.

Further embodiments of this disclosure include a DNA expression system including: (a) DNA sequence for a first promoter; and (b) operably linked and heterologous to the first promoter, a DNA sequence encoding a functional RNA molecule including a Cas12a tracrRNA and a functional RNA moiety. The functional RNA moiety is characterized by one or more functions. Embodiments of the RNA moiety include RNA sequences for annealing to one or more polynucleotides, RNA sequences that provide structures for binding to other molecules (including proteins or small molecule ligands) or that are catalytically active, or RNA sequences that serve as directly or indirectly detectable labels. In embodiments, the DNA expression system further includes: (c) optionally, a DNA sequence for a second promoter; (d) operably linked and heterologous to the first promoter or the second promoter, a DNA encoding a Cas12a crRNA that includes a 3' extension capable of hybridizing with a segment of the functional RNA molecule; and (e) optionally, a terminator. In embodiments, the functional RNA molecule includes a Cas12a tracrRNA having an RNA sequence selected from the group consisting of SEQ ID NOs:1, 3, 6, 139-146, 149-169, 223-240, and 241; in some embodiments, the first promoter includes a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter; in some embodiments, the optional second promoter includes a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter; in some embodiments, the optional terminator includes a DNA sequence selected from the group consisting of SEQ ID NOs:72-100 or comprise a U6 poly-T terminator, an SV40 terminator, an hGH terminator, a BGH terminator, an rbGlob terminator, or a synthetic terminator functional in a eukaryotic cell. In embodiments wherein the DNA expression system includes the DNA encoding the Cas12a crRNA, the DNA expression system can be provided in a single construct (e.g., where the first promoter drives expression of both the DNA encoding the functional RNA molecule and the DNA encoding the Cas12a crRNA). In embodiments wherein the DNA expression system includes the second promoter, the second promoter can be operably linked to the DNA encoding the crRNA (e.g., in a second construct). In embodiments where the DNA expression system is provided in two constructs, these can be in a single vector or in separate vectors. In embodiments, the Cas12a tracrRNA further includes a 5' extension. In many embodiments of the DNA expression system, the Cas12a crRNA is capable of complexing with a Cas12a nuclease to form a Cas12a ribonucleoprotein complex.

The various embodiments of the DNA expression systems disclosed herein are useful for expression of a Cas12a tracrRNA that is: (1) contained in a first RNA molecule including a Cas12a tracrRNA and including a restriction endonuclease cleavage site (native or engineered) that is suitable for insertion of a sequence coding for a functional RNA moiety, or (2) contained in a functional RNA molecule including a Cas12a tracrRNA and a functional RNA moiety. In embodiments, a Cas12a nuclease is associated or complexed with a Cas12a crRNA that is previously, simultaneously, or subsequently associated with, complexed with, or tethered to the Cas12a tracrRNA that is (1) contained in a first RNA molecule including a Cas12a tracrRNA and including a restriction endonuclease cleavage site (native or engineered) that is suitable for insertion of a sequence coding for a functional RNA moiety, or (2) contained in a functional RNA molecule including a Cas12a tracrRNA and a functional RNA moiety, thus forming a Cas12a ribonucleoprotein complex. In embodiments, the resulting Cas12a ribonucleoprotein complex contains (1) the Cas12a nuclease complexed with the first RNA molecule including a Cas12a tracrRNA and including a restriction endonuclease cleavage site (native or engineered) that is suitable for insertion of a sequence coding for a functional RNA moiety, or (2) the Cas12a nuclease complexed with the functional RNA molecule including a Cas12a tracrRNA and a functional RNA moiety. In embodiments, the Cas12a nuclease is one having a naturally occurring sequence (e.g., a native sequence of a Cas12a nuclease such as, but not limited to, LbCas12a, AsCas12a, FnCas12a, and an ObCsm1); in other embodiments, the Cas12a nuclease includes a modification, such as an amino acid sequence modification (e.g., the point-mutations provided in Table 5) and/or a chemical modification such as (a) a localization or signal peptide (e.g., a nuclear localization signal (NLS), a chloroplast or plastid transit peptide (CTP), or a mitochondrial targeting peptide (MTP)); (b) a detectable label (e.g., a fluorescent dye); (c) a cell-penetrating peptide; (d) an endosomal escape peptide; and (e) an affinity tag. In embodiments, the Cas12a nuclease is one selected from the Cas12a ("Cpf1") nucleases, Cpf1 orthologues, and Cpf1 variants (including the codon-optimized variants) disclosed in U.S. Pat. No. 9,790,490; the Cas12a ("Cpf1") nuclease sequences disclosed in U.S. Patent Application Publication 2018/0282713 (see, e.g., FIG. 3 and Example 5); and Cas12a ("Cpf1") nuclease sequences disclosed in U.S. Pat. No. 9,896,696; all of these cited patents and patent application publications are incorporated herein by reference. In specific embodiments, the Cas12a nuclease is a Cas12a ("Cpf1") nuclease identified from *Francisella novicida* U112 (FnCas12a or "FnCpf1"), from *Acidaminococcus* sp. BV3L6 (AsCas12a or "AsCpf1"), or from *Lachnospiraceae bacterium* ND2006 (LbCas12a or "LbCpf1"), or is an orthologue thereof, such as an orthologue having at least 50% sequence identity to FnCas12a ("FnCpf1"); see, e.g., the FnCpf1 nuclease contained in the FnCpf1 locus having SEQ ID NO:211 in U.S. Pat. No. 9,790,490, specifically incorporated herein by reference. In other specific embodiments, the Cas12a nuclease is a Cas12a nuclease having Cas12a nuclease activity and having at least 80%, at least 85%, at least 90%, or at least 95% sequence identity with a sequence selected from the group consisting of SEQ ID NOs:11, 107-138, 172, 204-221, and 222. Table 5 provides non-limiting examples of Cas12a nucleases and sequence variants thereof that are useful with the DNA expression systems and engineered systems provided in this disclosure. Most of the point mutations (those not marked with an * or **) provided in Table 5 are designed to increase the efficiency or efficacy of gene editing by the nuclease (in comparison to the unaltered native nuclease). Increased efficiency or efficacy of gene editing includes but is not limited to: altered translation, folding, and/or stability of the Cas12a nuclease or ribonucleoprotein; altered affinity and/or specificity of target binding; altered Cas12a nuclease efficiency on target and/or non-target strands; altered PAM recognition specificity; and altered DNA repair or modification outcomes (e.g., indel rates). The Ca12a nuclease sequence variants include: (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; and (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A. The systems and compositions including a tracrRNA and methods of use thereof that are disclosed herein can also be employed with related Cas nucleases, including Csm nucleases, e.g., ObCsm1 (GenBank accession number OGX23684), SmCsm1 (GenBank accession number KF067988), MiCsm1 (GenBank accession number KKQ38176), or SuCsm1 (GenBank accession number KIM12007) (see, e.g., Begemann et al. (2017) bioRxiv, publicly available at dx[dot]doi[dot]org/10[dot]1101/192799), nucleases having a sequence selected from the group consisting of SEQ ID NOs:115, 137, 138, and variants thereof, such as a variant ObCsm1 that differs from a wild-type ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

merase binding site and initiator for in vitro transcription using the HiScribe™ T7 High Yield RNA Synthesis Kit (catalogue number E2050S, New England BioLabs, Ipswich, MA). Alternatively, the 3'-extended crRNA is chemically synthesized by IDT (Coralville, IA), optionally containing chemical modifications or non-natural components. The 3'-extended crRNA is further modified to contain a fluorescent or fluorophore-conjugated nucleotide or nucleotide analog, such as cytidine-5'-phosphate-3'-(6-aminohexyl)phosphate conjugated to Cy5 (NU-1706-CY5, Jena Bioscience, Jena, Germany), at its 3' end using T4 RNA ligase. Alternatively, the 3'-extended crRNA containing one or multiple fluorescent components within or following the polynucleotide extension (e.g., 3' ATTOTM 590 (NHS Ester)) is chemically synthesized by IDT (Coralville, IA).

TABLE 5

| LbCpf1 (WP_051666128) (SEQ ID NO:135) | AsCpf1 (WP_021736722) (SEQ ID NO:134) | FnCpf1 (WP_003034647) (SEQ ID NO:172) | ObCsm1 (OGX23684) (SEQ ID NO:137) |
|---|---|---|---|
| G309P | L320P | I339P | — |
| Y312F | wt | L342F | — |
| M474I | wt | wt | — |
| D523N | wt | wt | K382N |
| Q531K | wt | Q588K | Q393K |
| C930A | V980A | wt | S925A |
| D937N | Q987N | wt | E933N |
| V954F/Q | T1004F/Q | F1017Q | K943F/Q |
| M975L | wt | wt | K972L |
| A984E | K1035E | K1047E | — |
| I994L | wt | wt | — |
| T1006K | T1057K | wt | wt |
| I1014V | wt | wt | wt |
| V1055N/D | D1107N | N1118D | — |
| L1065F/Y | F1117Y | F1128Y | — |
| Y1180F | wt | wt | wt |
| V1209G | wt | wt | K1064G |
| I1229L | N1291L | wt | — |
| V801I* | wt | L867I* | P670I* |
| Y802I* | wt | wt | N671I* |
| D850A** | D908A** | D917A** | D727A** |
| E943A** | E993A** | E1006A** | E939A** |
| D1198A** | D1263A** | D1255A** | D1053A** |

"wt" = wild type
*mutation expected to increase stabilization of nuclease/crRNA association
**mutation expected to decrease or eliminate endonuclease activity Example 7

This example illustrates compositions and systems including a Cas112a nuclease, a Cas112a crRNA that comprises a 3' extension, and a Cas12a tracrRNA. More specifically, this illustrates an engineered system including a Cas 12a crRNA that includes an artificial 3' ribonucleotide extension including a detectable label (a fluorophore) for in vivo identification of cells containing the Cas112a crRNA. The Cas112a crRNA is synthesized for delivery to plant cells as a ribonucleoprotein complex with a Cas112a nuclease, and (2) cloned into a plant expression vector system for co-expression with Cas12a in vivo.

A ZmLc crRNA was designed with the nucleotide sequence of SEQ ID NO: 179 including the direct repeat sequence of SEQ ID NO: 180 and the spacer sequence of SEQ ID NO: 181 for targeting the promoter of the *Zea mays* Lc gene (GRMVZM5G822829); this ZmLc crRNA sequence was modified to contain 11 nucleotides adjacent to and 3' to the spacer region, yielding an engineered 3'-extended ZmLc crRNA. The 3'-extended crRNA sequence is encoded into a dsDNA template downstream of a T7 poly- Fluorescent Cas12a ribonucleoprotein complexes (RNPs) are generated with the fluorophore-labelled 3'-extended crRNA, a modified Cas12a nuclease (SEQ ID NO:182), and a Cas12 tracrRNA (SEQ ID NO:3) following the protocols described below in Example 8, incubated with nanoparticles (e.g., 0.6 micrometer gold microcarriers, catalogue number 1652262, BioRad Laboratories, Inc., Hercules, CA), and biolistically delivered to meristematic tissue using standard protocols similar to or adapted from Liang et al. (2017) *Nature Communications*, 8:14261, doi:10.1038/ncomms14261. Meristems are further visualized under a fluorescent microscope several hours following delivery to identify and isolate transformed meristem from non-transformed cells or tissue. Optionally, the transformed meristem is grown into callus or plants.

Example 8

This example illustrates compositions and engineered genome editing systems including a Cas12a nuclease, a Cas12acrRNA, and a Cas12a tracrRNA. In addition to the usefulness of an RNA molecule including a Cas12a tracrRNA for, e.g., tethering a donor polynucleotide to a Cas12a nuclease/crRNA ribonucleoprotein (RNP) complex, it was discovered that addition of a molar excess of tracrRNA to an editing system including a Cas12a nuclease/crRNA RNP unexpectedly resulted in an increase of the overall efficiency of genome editing at a given concentration of RNP.

Protoplasts were prepared from leaves of 2-week old maize (Zea mays, variety B104) plants, following a protocol previously described (see Example 1 in U.S. patent application Ser. No. 16/480,992 (filed on 25 Jul. 2019 as the national phase application based on PCT/US2018/015793 filed on 29 Jan. 2018 and published as WO2018/140899), incorporated herein by reference.

Reagents were prepared as follows. The modified Cas12a nuclease employed in this experiment had the amino acid sequence of SEQ ID NO:182; included in this sequence are (a) the native Cas12a nuclease sequence (amino acids positions 19-1246 of SEQ ID NO:182), (b) remains of a linker sequence (amino acid positions 1-7 of SEQ ID NO:182), (c) two linker sequences (amino acid positions 15-18 and 1247-1250 of SEQ ID NO:182), (d) an N-terminus nuclear localization signal (NLS) sequence (amino acid positions 8-14 of SEQ ID NO:182), and (e) a C-terminus linker/NLS (amino acid positions 1247-1259 of SEQ ID NO:182). The Cas12a nuclease (5.85 milligrams/milliliter in aqueous buffer containing 25 millimolar Tris-HCl, 300 millimolar NaCl, 0.1 millimolar EDTA, pH 7.4) was diluted with dilution buffer (25 millimolar Tris-HCl, 300 millimolar NaCl, 0.1 millimolar EDTA, 40% glycerol, pH 7.4) to a final concentration of 1.25 milligrams/milliliter nuclease and 31.5% glycerol. A 30 micromolar solution of Cas12a tracrRNA with the nucleotide sequence of SEQ ID NO:3 was prepared in reaction buffer (40 mM HEPES, 200 mM NaCl, 10 mM MgCl2, and 0.2 mM EDTA, pH 6.5). Additional solutions of 40% polyethylene glycol 4000 (PEG), maize washing solution (0.6 molar mannitol, 4 millimolar MES pH 5.7, and 20 millimolar KCl), and PIM containing 50 millimolar $CaCl_2$ (previously described in Table 25, U.S. patent application Ser. No. 16/480,992, filed on 25 Jul. 2019 as the national phase application based on PCT/US2018/015793 filed on 29 Jan. 2018 and published as WO2018/140899, incorporated herein by reference) were prepared. All solutions were aliquoted into 96-well deep plates and sealed until needed for use in a Biomek $FX^P$ automated liquid handler (Beckman Coulter Life Sciences, Indianapolis, IN).

Ribonucleoproteins (RNPs) were prepared with a Cas12a nuclease having the sequence of SEQ ID NO:182 and an ZmLc crRNA with the nucleotide sequence of SEQ ID NO:179 including the direct repeat sequence of SEQ ID NO:180 and the spacer sequence of SEQ ID NO:181 for targeting the promoter of the Zea mays Lc gene (GRMZM5G822829). Following a preferred protocol, the ZmLc crRNA was resuspended in reaction buffer to a concentration of 25 micromolar; 1680 microliters of the diluted ZmLc crRNA was mixed with 560 microliters of the Cas12a nuclease solution and incubated 20 minutes at room temperature. To this mixture 1400 microliters of the Cas12a tracrRNA was added and mixed; this "Cas12a nuclease/ZmLc crRNA/tracrRNA editing system" was apportioned in 225 microliter aliquots into 8-strip PCR tubes.

Four mixtures were prepared for use as diluents.

"Diluent 1" (Cas12a nuclease/GmSHAT1-5 crRNA/tracrRNA) was prepared by mixing 420 microliters of 25 micromolar GmSHAT1-5 crRNA (serving as a non-specific Cas12a crRNA, this was designed to target Glycine max SHAT1-5, see www[dot]uniprot[dot]org/uniprot/W8E7P1) in reaction buffer (40 mM HEPES, 200 mM NaCl, 10 mM MgCl2, and 0.2 mM EDTA, pH 6.5) and 140 microliters of the Cas12a nuclease solution, incubating for 20 minutes at room temperature, and then adding 350 microliters of the Cas12a tracrRNA solution. This was apportioned in 225 microliter aliquots into 8-strip PCR tubes.

"Diluent 2" (Cas12a nuclease/GmSHAT1-5 crRNA) was prepared by mixing 420 microliters of 25 micromolar GmSHAT5-1 crRNA in reaction buffer (40 mM HEPES, 200 mM NaCl, 10 mM MgCl2, and 0.2 mM EDTA, pH 6.5) and 140 microliters of the Cas12a nuclease solution, incubating for 20 minutes at room temperature, and then adding 350 microliters of the reaction buffer (40 mM HEPES, 200 mM NaCl, 10 mM MgCl2, and 0.2 mM EDTA, pH 6.5). This was apportioned in 225 microliter aliquots into 8-strip PCR tubes.

"Diluent 3" (Cas12a tracr) was prepared by mixing 350 microliters of the Cas12a tracrRNA solution with 560 microliters of reaction buffer (40 mM HEPES, 200 mM NaCl, 10 mM MgCl2, and 0.2 mM EDTA, pH 6.5). This was apportioned in 225 microliter aliquots into 9-strip PCR tubes.

"Diluent 4" consisted of reaction buffer (40 mM HEPES, 200 mM NaCl, 10 mM MgCl2, and 0.2 mM EDTA, pH 6.5) only. This was apportioned in 225 microliter aliquots into 9-strip PCR tubes.

Transfections of the maize protoplasts were carried out in the Biomek $FX^P$ automated liquid handler. A 16-microliter aliquot of the protoplast suspension was added to each well of a U-Bottom 96 well plate pre-coated with 5% Calf Serum with lid removed. A titration series of the Cas12a nuclease/ZmLc crRNA/tracrRNA editing system was made across twelve wells of a master titration plate using the four different diluents; this was stored on the cold block until transfection. The titrations resulted in a dilution series of the Cas12a nuclease/ZmLc crRNA/tracrRNA editing system, as shown in Table 6, which provides the resulting ratios between the additional Cas12a tracrRNA (provided in the diluent) to Cas12a nuclease (provided in the Cas12a nuclease/ZmLc crRNA/tracrRNA editing system).

TABLE 6

| Cas12a nuclease (pmol) | Cas12a tracrRNA (pmol) | Cas12a tracrRNA:Cas12a nuclease ratio |
|---|---|---|
| 0.00 | 193.70 | — |
| 2.13 | 193.70 | 90.81 |
| 4.06 | 193.70 | 47.71 |
| 5.99 | 193.70 | 32.36 |
| 7.88 | 193.70 | 24.59 |
| 9.80 | 193.70 | 19.76 |
| 11.73 | 193.70 | 16.51 |
| 13.66 | 193.70 | 14.18 |
| 15.58 | 193.70 | 12.43 |
| 17.48 | 193.70 | 11.08 |
| 19.40 | 193.70 | 9.98 |
| 21.33 | 193.70 | 9.08 |

Transfections were performed in triplicate. For transfection, 16 microliters of a given titrated dilution was added to each protoplast-containing well, and mixed; 32 microliters of 40% PEG solution are added and mixed, and the plate incubated 5 minutes at room temperature. Sequential additions of maize washing buffer were dispensed across the plate and mixed, and the plate was removed from the automated liquid handler, covered, and centrifuged. The plate was returned to the automated liquid handler for removal of the majority of the supernatant, and the protoplasts resuspended in 120 microliters PIM containing 50 millimolar CaCl$_2$. The plate was covered and incubated at 27 degrees Celsius in the dark for 48 hours before harvesting. Genomic DNA was isolated from the protoplasts, quantified using QuantiFluor (Promega Corporation, Madison, WI), and subjected to PCR amplification followed by amplicon sequencing to detect indel edits.

Figure 12:
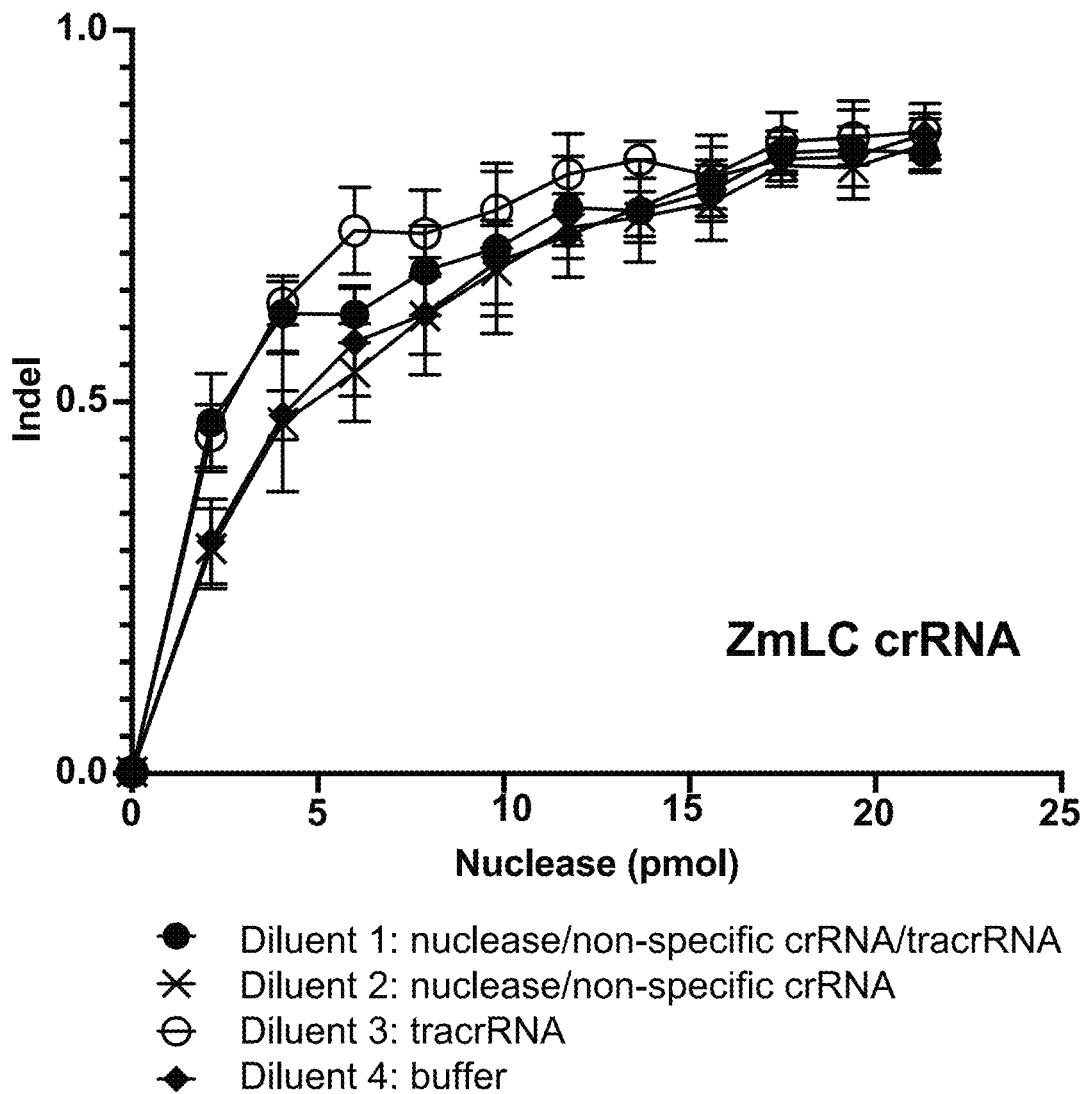
FIG. 12 depicts the results of the experiment described in Example 8 using the GD-30 crRNA. The data are provided as the fraction of edited protoplasts (the number of protoplasts containing an insertion/deletion (indel) at the predicted cleavage site, divided by the total number of protoplasts treated) versus the amount in pmoles of Cas12a nuclease used.

Results, given as the fraction of protoplasts containing an indel at the predicted cleavage site versus the amount of Cas12a nuclease used, are illustrated in FIG. 12. The data indicate that dilutions made with Diluent 2 (Cas12a nuclease/GmSHAT1-5 crRNA in reaction buffer) had no significant effect when compared to the control dilution with Diluent 4 (reaction buffer only). In contrast, dilutions made with Diluent 3 (Cas12a tracrRNA in reaction buffer) markedly increased the editing efficiency at the majority of the nuclease amounts tested; the additional Cas12a tracrRNA appeared to decrease the amount of Cas12a nuclease required to achieve 75% editing to 5.99 pmol, i.e., about a third of the Cas12a nuclease amount needed to achieve the same level of editing efficiency in the control dilution (15.58 pmol). Dilutions made with Diluent 1 (Cas12a nuclease/GmSHAT1-5 crRNA/tracrRNA in reaction buffer) also appeared to slightly increase the editing efficiency of a given amount of Cas12a nuclease; since the difference between Diluent 1 and Diluent 2 was the presence of the Cas12a tracrRNA, it is likely that the increased editing efficiency was due to the Cas12a tracrRNA.

Example 9

This example illustrates compositions and engineered genome editing systems including a Cas12a nuclease, a Cas12acrRNA, and a Cas12a tracrRNA. More specifically, this example illustrates additional experiments that confirmed that addition of a molar excess of tracrRNA to an editing system including a Cas12a nuclease/crRNA RNP unexpectedly resulted in an increase of the overall efficiency of genome editing at a given concentration of RNP.

To further investigate the effects of including a molar excess of Cas12a tracrRNA in a Cas12a nuclease/crRNA/tracrRNA editing system, additional experiments were carried out using different Cas12a crRNAs.

Protoplasts were prepared from etiolated middle leaves of 12-day old maize (*Zea mays*, variety B104) plants, following a protocol previously described (see Example 1 in U.S. patent application Ser. No. 16/480,992 (filed on 25 Jul. 2019 as the national phase application based on PCT/US2018/015793 filed on 29 Jan. 2018 and published as WO2018/140899), incorporated herein by reference.

One experiment tested the effects of various diluents on Cas12a RNPs including a Cas12a nuclease and a "high-performing" Cas12a crRNA, GD-48, which routinely produced indel edits at a frequency between 80-90%. Another experiment tested the effects of various diluents on Cas12a RNPs including a Cas12a nuclease and a "low-performing" Cas12a crRNA, GD-14, which routinely produced indel edits at frequencies below 25%. The nucleotide sequence of both Cas12a crRNAs included, from 5' to 3', a direct repeat sequence (SEQ ID NO:180) and a spacer sequence having perfect complementarity to a specific target sequence in the maize B104 genome.

Experimental procedures were similar to those described in Example 8. The Cas12a nuclease (SEQ ID NO:182) (5.85 milligrams/milliliter in aqueous buffer containing 25 millimolar Tris-HCl, 300 millimolar NaCl, 0.1 millimolar EDTA, pH 7.4) was diluted with dilution buffer (25 millimolar Tris-HCl, 300 millimolar NaCl, 0.1 millimolar EDTA, 40% glycerol, pH 7.4) to a final concentration of 1.25 milligrams/milliliter nuclease and 31.5% glycerol. A 30 micromolar solution of Cas12a tracrRNA (SEQ ID NO:3) was prepared in reaction buffer (40 mM HEPES, 200 mM NaCl, 10 mM MgCl2, and 0.2 mM EDTA, pH 6.5). A 1.25 milligram/milliliter solution of bovine serum albumen (BSA) was prepared in protein storage buffer (25 millimolar Tris-HCl, 300 millimolar NaCl, 0.1 millimolar EDTA, 1 millimolar dithiothreitol, 40% glycerol, pH 7.4). Additional solutions of 40% polyethylene glycol 4000 (PEG), maize washing solution (0.6 molar mannitol, 4 millimolar MES pH 5.7, and 20 millimolar KCl), and PIM containing 50 millimolar CaCl$_2$ (previously described in Table 25, U.S. patent application Ser. No. 16/480,992, filed on 25 Jul. 2019 as the national phase application based on PCT/US2018/015793 filed on 29 Jan. 2018 and published as WO2018/140899, incorporated herein by reference) were prepared. All solutions were aliquoted into 96-well deep plates and sealed until needed for use in a Biomek FX$^P$ automated liquid handler (Beckman Coulter Life Sciences, Indianapolis, IN).

Cas12a ribonucleoproteins (RNPs) were prepared with a Cas12a nuclease having the sequence of SEQ ID NO:182 and the "high-performing" Cas12a crRNA, GD-48 as well as the "low-performing" Cas12a crRNA, GD-14. Following a preferred protocol, each Cas12a crRNA was resuspended in reaction buffer to a concentration of 25 micromolar; 1680 microliters of the diluted Cas12a crRNA was mixed with 560 microliters of the Cas12a nuclease solution and incubated 20 minutes at room temperature. To this mixture 1400 microliters of the Cas12a tracrRNA was added and mixed; the resulting "Cas12a nuclease/GD-48 crRNA/tracrRNA editing system" and "Cas12a nuclease/GD-14 crRNA/tracrRNA editing system" were apportioned in 225 microliter aliquots into 8-strip PCR tubes.

Four mixtures were prepared for use as diluents.

"Diluent 1" (Cas12a nuclease/GmSHAT1-5 crRNA/tracrRNA) was prepared by mixing 420 microliters of 25 micromolar GmSHAT1-5 crRNA in reaction buffer (40 mM HEPES, 200 mM NaCl, 10 mM MgCl2, and 0.2 mM EDTA, pH 6.5) and 140 microliters of the Cas12a nuclease solution, incubating for 20 minutes at room temperature, and then adding 350 microliters of the Cas12a tracrRNA solution. This was apportioned in 225 microliter aliquots into 8-strip PCR tubes.

"Diluent 2" (BSA) was prepared by mixing 140 microliters of the BSA stock solution with 770 microliters of reaction buffer (40 mM HEPES, 200 mM NaCl, 10 mM MgCl2, and 0.2 mM EDTA, pH 6.5). This was apportioned in 225 microliter aliquots into 8-strip PCR tubes.

"Diluent 3" (GmSHAT1-5 crRNA/tracrRNA) was prepared by mixing 420 microliters of the GmSHAT1-5 crRNA, 350 microliters of the Cas12a tracrRNA solution, and 140 microliters of reaction buffer (40 mM HEPES, 200 mM NaCl, 10 mM MgCl2, and 0.2 mM EDTA, pH 6.5). This was apportioned in 225 microliter aliquots into 9-strip PCR tubes.

"Diluent 4" consisted of reaction buffer (40 mM HEPES, 200 mM NaCl, 10 mM MgCl2, and 0.2 mM EDTA, pH 6.5) only. This was apportioned in 225 microliter aliquots into 9-strip PCR tubes.

Transfections of the maize protoplasts were carried out in the Biomek FX$^P$ automated liquid handler. A 16-microliter aliquot of the protoplast suspension was added to each well of a U-Bottom 96 well plate pre-coated with 5% Calf Serum with lid removed. A titration series of the Cas12a nuclease/ZmLc crRNA/tracrRNA editing system was made across twelve wells of a master titration plate using the four different diluents; this was stored on the cold block until transfection.

Transfections were performed in triplicate. For transfection, 16 microliters of a given titrated dilution was added to each protoplast-containing well, and mixed; 32 microliters of 40% PEG solution are added and mixed, and the plate incubated 5 minutes at room temperature. Sequential additions of maize washing buffer were dispensed across the plate and mixed, and the plate was removed from the automated liquid handler, covered, and centrifuged. The plate was returned to the automated liquid handler for removal of the majority of the supernatant, and the protoplasts resuspended in 120 microliters PIM containing 50 millimolar $CaCl_2$. The plate was covered and incubated at 27 degrees Celsius in the dark for 36 hours before harvesting. Genomic DNA was isolated from the protoplasts, quantified using QuantiFluor (Promega Corporation, Madison, WI), and subjected to PCR amplification followed by amplicon sequencing to detect indel edits.

Figure 13:
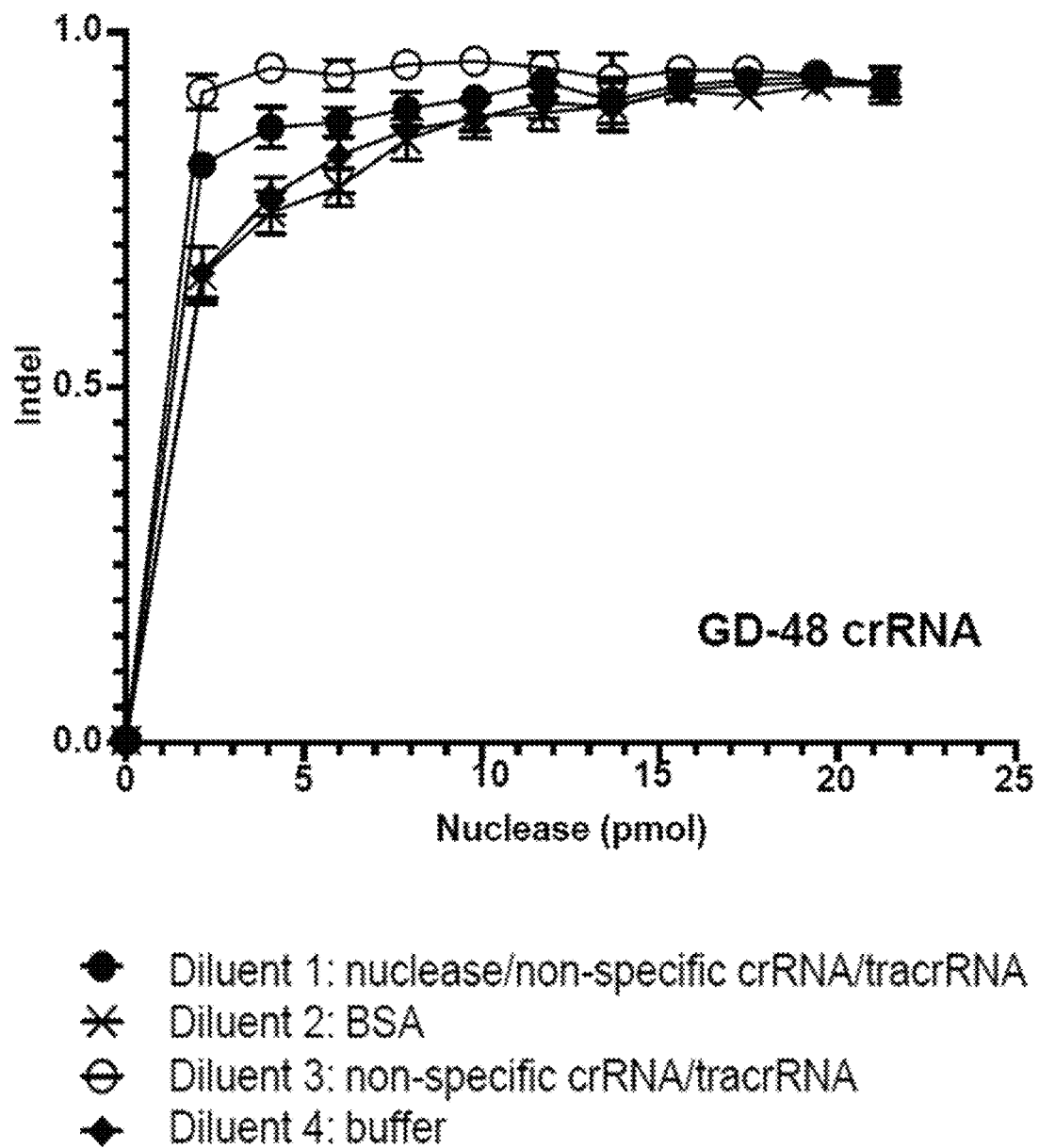
FIG. 13 depicts the results of the experiment using a "high-performing" Cas12a crRNA, GD-48, as described in Example 9. The data are provided as the fraction of edited protoplasts (the number of protoplasts containing an insertion/deletion (indel) at the predicted cleavage site, divided by the total number of protoplasts treated) versus the amount in pmoles of Cas12a nuclease used.
Figure 14:
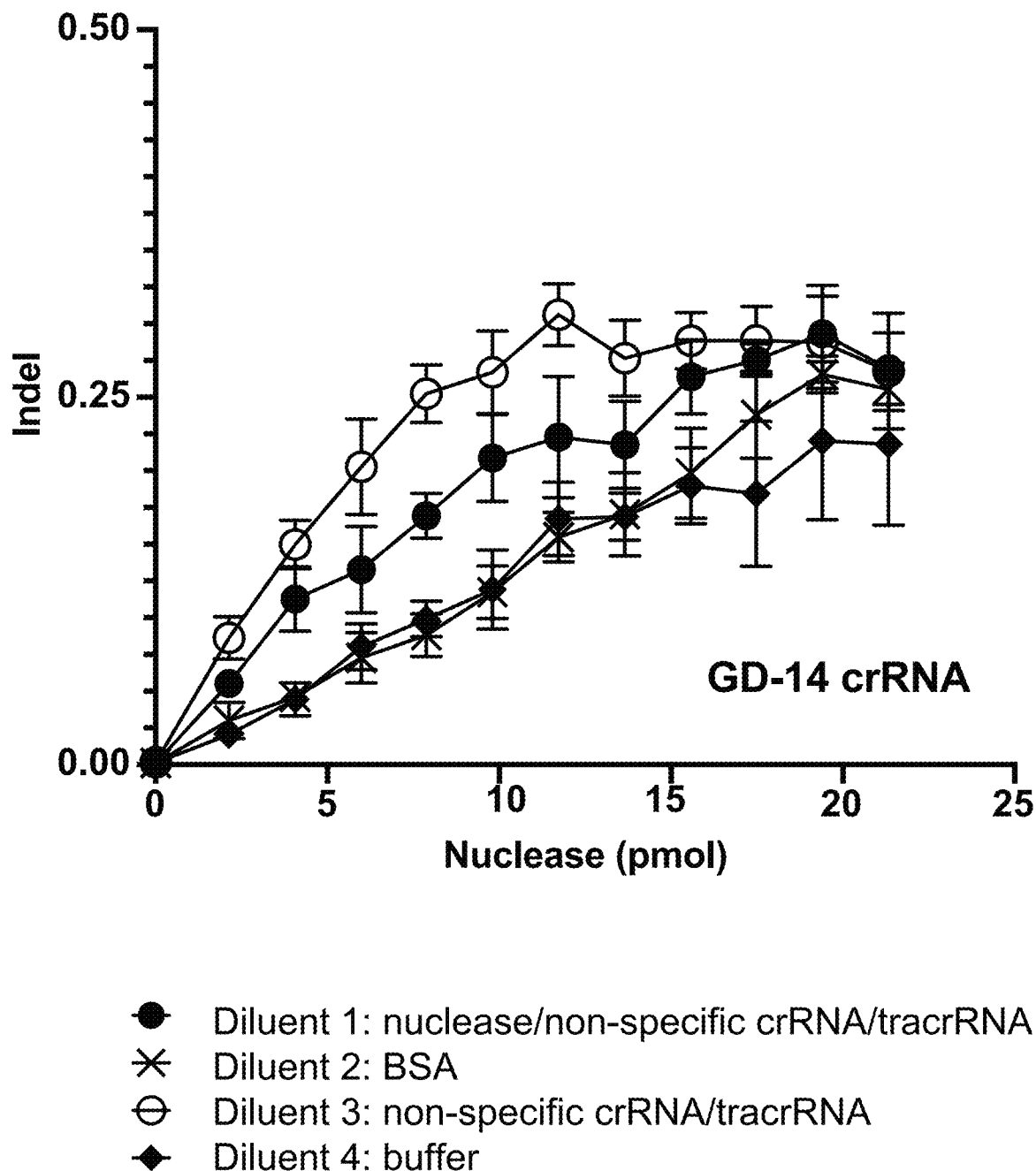
FIG. 14 depicts the results of the experiment using a "low-performing" Cas12a crRNA, GD-14, as described in Example 9. The data are provided as the fraction of edited protoplasts (the number of protoplasts containing an insertion/deletion (indel) at the predicted cleavage site, divided by the total number of protoplasts treated) versus the amount in pmoles of Cas12a nuclease used.

Results, given as the fraction of protoplasts containing an indel at the predicted cleavage site versus the amount of Cas12a nuclease used, are illustrated in FIGS. 13 and 14. The data indicate that dilutions made with Diluent 2 (BSA in reaction buffer) had no significant effect when compared to the control dilution with Diluent 4 (reaction buffer only). In contrast, dilutions made with Diluent 3 (GmSHAT1-5 crRNA/tracrRNA in reaction buffer) markedly increased the editing efficiency at the majority of the Cas12a nuclease amounts tested for both Cas12a crRNAs tested. In the case of the "high-performing" Cas12a crRNA, GD-48, the indel editing frequency reached about maximum (about 90-95%) at much lower Cas12a nuclease concentrations with Diluent 3 than with Diluent 4 (reaction buffer control); use of this Cas12a tracrRNA-containing diluent appeared to decrease the amount of Cas12a nuclease required to achieve about 90% editing to about 2.13 pmol, i.e., about one-seventh the amount of Cas12a nuclease needed to achieve the same level of editing efficiency in the control dilution (15.58 pmol). Dilutions made with Diluent 1 (Cas12a nuclease/GmSHAT1-5 crRNA/tracrRNA in reaction buffer) also appeared to increase the editing efficiency of a given amount of Cas12a nuclease; use of this diluent appeared to decrease the amount of Cas12a nuclease required to achieve about 90% editing to about 11.73 pmol, i.e., about 75% of the amount of Cas12a nuclease needed to achieve the same level of editing efficiency in the control dilution (15.58 pmol).

In the case of the "low-performing" Cas12a crRNA, GD-14, the indel editing frequency reached about maximum (about 30%) at much lower Cas12a nuclease concentrations with Diluent 3 than with Diluent 4 (the reaction buffer control). Furthermore, use of Diluent 3 resulted in a higher maximum indel editing frequency (about 30%), compared to that obtained with Diluent 4 (only about 20%). Thus, use of Diluent 3 increased overall indel editing efficiency by about fifty percent, and reached maximum editing efficiency at a Cas12a nuclease concentration that was estimated to be at least less than half of the Cas12a nuclease concentration needed to reach the maximum editing efficiency observed in the control dilution. Dilutions made with Diluent 1 (Cas12a nuclease/GmSHAT1-5 crRNA/tracrRNA in reaction buffer) also appeared to increase the editing efficiency of a given amount of Cas12a nuclease; the maximum editing efficiency (about 30%) was also greater than that seen with Diluent 4, and this level was reached with about 15.58 pmol of Cas12a nuclease in Diluent 1.

Various embodiments of the systems, methods, and compositions provided herein are included in the following non-limiting list of numbered embodiments.

1. A method of tethering a functional RNA molecule to a Cas12a crRNA, the method comprising hybridizing
   (a) a functional RNA molecule comprising a Cas12a tracrRNA and a functional RNA moiety; and
   (b) a Cas12a crRNA that comprises a 3' extension capable of hybridizing with a segment of the functional RNA molecule;
   thereby tethering the functional RNA molecule to the Cas12a crRNA.
2. The method of embodiment 1, wherein the functional RNA molecule is provided by transcription of a DNA molecule comprising DNA encoding the Cas12a tracrRNA and DNA encoding the functional RNA moiety, wherein the DNA encoding the functional RNA moiety is inserted at a restriction endonuclease cleavage site in or adjacent to the DNA encoding the Cas12a tracrRNA.
3. The method of embodiment 2, wherein the restriction endonuclease cleavage site is native.
4. The method of embodiment 2, wherein the restriction endonuclease cleavage site is artificial.
5. The method of embodiment 1, wherein the crRNA 3' extension comprises nucleotides that when base-paired form about one helical turn.
6. The method of embodiment 1, wherein the crRNA 3' extension comprises at least 10 contiguous nucleotides.
7. The method of any one of embodiments 1 to 6, wherein the functional RNA moiety is at least one selected from the group consisting of:
   (a) an RNA sequence for annealing to a donor polynucleotide;
   (b) an RNA sequence for annealing to the crRNA 3' extension;
   (c) a terminator sequence;
   (d) an RNA aptamer;
   (e) a ribozyme;
   (f) a detectable label;
   (g) a bar-coding sequence; and
   (h) an RNA sequence forming at least partially double-stranded RNA.
8. The method of any one of embodiments 1 to 6, wherein the functional RNA moiety comprises RNA forming at least partially double-stranded RNA capable of silencing a gene.
9. The method of any one of embodiments 1 to 8, wherein the Cas12a crRNA is complexed with, or is capable of complexing with, a Cas12a nuclease to form a Cas12a ribonucleoprotein complex containing the functional RNA molecule.
10. The method of embodiment 9, wherein the Cas12a nuclease is:
    (a) a Cas12a nuclease identified from the genome of a bacterial species selected from the group consisting of *Francisella tularensis* 1, *Prevotella albensis, Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, *Candidatus Methanoplasma termitum, Eubacterium eligens, Moraxella bovoculi* 237, *Leptospira inadai, Lachnospiraceae bacterium* ND2006, *Porphyromonas crevioricanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or
(c) a Cas12a nuclease having at least 80% sequence identity with a sequence selected from the group consisting of SEQ ID NOs:11, 107-138, 172, 204-221, and 222; or
(d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A; and (4) a variant ObCsm1 sequence that differs from a wildtype ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

11. The method of embodiment 9 or embodiment 10, wherein the Cas12a nuclease comprises at least one modification selected from the group consisting of:
(a) a localization signal;
(b) a detectable label;
(c) a cell-penetrating peptide;
(d) an endosomal escape peptide; and
(e) an affinity tag.

12. A modified Cas12a ribonucleoprotein complex comprising
(a) a Cas12a nuclease;
(b) a functional RNA molecule comprising a Cas12a tracrRNA and a functional RNA moiety; and
(c) a Cas12a crRNA that comprises a 3' extension capable of hybridizing with a segment of the functional RNA molecule.

13. The modified Cas12a ribonucleoprotein complex of embodiment 12, wherein the Cas12a nuclease is:
(a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens* and *Porphyromonas macacae*; or
(b) a Cas12a nuclease selected from the group consisting of LbCas12a, AsCas12a, FnCas12a, and a deactivated Cas12a nuclease; or
(c) a Cas12a nuclease having at least 80% sequence identity with a sequence selected from the group consisting of SEQ ID NOs:11, 107-138, 172, 204-221, and 222; or
(d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A; and (4) a variant ObCsm1 sequence that differs from a wildtype ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

14. The modified Cas12a ribonucleoprotein complex of embodiment 12 or embodiment 13, wherein the Cas12a nuclease comprises at least one modification selected from the group consisting of:
(a) a localization signal;
(b) a detectable label;
(c) a cell-penetrating peptide;
(d) an endosomal escape peptide; and
(e) an affinity tag.

15. A method of integrating a nucleotide sequence encoded by a donor polynucleotide at a specific locus in a target DNA, the method comprising:
(a) annealing a donor polynucleotide to the modified Cas12a ribonucleoprotein complex of embodiment 12, wherein the functional RNA moiety comprises an RNA sequence for annealing to the donor polynucleotide, and wherein the Cas12a crRNA comprises a spacer sequence that corresponds to a specific target locus in a target DNA, thus forming a donor:RNP complex; and
(b) contacting the target DNA with the donor:RNP complex;
whereby the nucleotide sequence encoded by the donor polynucleotide is integrated at the specific target locus in the target DNA.

16. The method of embodiment 15, wherein the donor polynucleotide comprises single-stranded DNA, optionally comprising chemical modifications.

17. The method of embodiment 15, wherein the donor polynucleotide comprises double-stranded DNA, optionally comprising chemical modifications.

18. A DNA expression system comprising
(a) DNA sequence for a first promoter; and
(b) operably linked and heterologous to the first promoter, DNA encoding a first RNA molecule comprising a Cas12a tracrRNA and comprising a restriction endonuclease cleavage site that is suitable for insertion of a sequence coding for a functional RNA moiety; and (c) optionally, a terminator 3' to and operably linked to the DNA encoding the first RNA molecule.

19. The DNA expression system of embodiment 18, wherein the restriction endonuclease cleavage site occurs natively in the DNA encoding the Cas12a tracrRNA.

20. The DNA expression system of embodiment 18, wherein the restriction endonuclease cleavage site is artificial.

21. The DNA expression system of embodiment 18, further comprising:

(d) optionally, a DNA sequence for a second promoter;

(e) operably linked and heterologous to the first promoter or the second promoter, DNA encoding a Cas12a crRNA that comprises a 3' extension capable of hybridizing with a segment of the first RNA molecule; and (f) optionally, a terminator 3' to and operably linked to the DNA encoding the Cas12a crRNA.

22. The DNA expression system of embodiment 21, wherein the first promoter and the DNA encoding the first RNA molecule, and the DNA encoding a Cas12a crRNA that comprises a 3' extension are contained in a single construct.

23. The DNA expression system of embodiment 21, comprising the second promoter, wherein the first promoter and the DNA encoding the first RNA molecule are contained in a first construct, and the second promoter and the DNA encoding a Cas12a crRNA that comprises a 3' extension are contained in a second construct.

24. The DNA expression system of embodiment 23, wherein the first construct and the second construct are provided (a) in a single vector, or (b) in separate vectors.

25. The DNA expression system of embodiment 21, wherein the first promoter drives expression of both the DNA encoding the first RNA molecule and the DNA encoding the Cas12a crRNA that comprises a 3' extension.

26. The DNA expression system of any one of embodiments 21 to 25, wherein the Cas12a tracrRNA further comprises a 5' extension.

27. The DNA expression system of any one of embodiments 21 to 26, wherein the Cas12a crRNA that comprises a 3' extension is capable of complexing with a Cas12a nuclease to form a Cas12a ribonucleoprotein complex.

28. The DNA expression system of embodiment 18, further comprising:

(d) optionally, a DNA sequence for a second promoter;

(e) operably linked and heterologous to the first promoter or the second promoter, DNA encoding a Cas12a crRNA capable of hybridizing with a segment of the first RNA molecule; and (f) optionally, a terminator 3' to and operably linked to the DNA encoding the Cas12a crRNA.

29. The DNA expression system of embodiment 28, wherein the first promoter and the DNA encoding the first RNA molecule, and the DNA encoding a Cas12a crRNA are contained in a single construct.

30. The DNA expression system of embodiment 28, comprising the second promoter, wherein the first promoter and the DNA encoding the first RNA molecule are contained in a first construct, and the second promoter and the DNA encoding a Cas12a crRNA are contained in a second construct.

31. The DNA expression system of embodiment 30, wherein the first construct and the second construct are provided (a) in a single vector, or (b) in separate vectors.

32. The DNA expression system of embodiment 28, wherein the first promoter drives expression of both the DNA encoding the first RNA molecule and the DNA encoding the Cas12a crRNA.

33. The DNA expression system of any one of embodiments 28 to 32, wherein the Cas12a tracrRNA further comprises a 5' extension.

34. The DNA expression system of any one of embodiments 28 to 33, wherein the Cas12a crRNA is capable of complexing with a Cas12a nuclease to form a Cas12a ribonucleoprotein complex.

35. The DNA expression system of embodiment 27 or embodiment 34, wherein the Cas12a nuclease is:

(a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens* and *Porphyromonas macacae*; or (b) a Cas12a nuclease selected from the group consisting of LbCas12a, AsCas12a, FnCas12a, and a deactivated Cas12a nuclease; or (c) a Cas12a nuclease having at least 80% sequence identity with a sequence selected from the group consisting of SEQ ID NOs:11, 107-138, 172, 204-221, and 222; or (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A; and (4) a variant ObCsm1 sequence that differs from a wildtype ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

36. The DNA expression system of any one of embodiments 18 to 35, wherein the first promoter has a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter and wherein the Cas12a tracrRNA has a nucleotide sequence comprising a sequence selected from the group consisting of SEQ ID NOs:1, 3, 6, 139-146, 149-169, 223-240, and 241.

37. A DNA expression system comprising:
(a) DNA sequence for a first promoter; and
(b) operably linked and heterologous to the first promoter, a DNA encoding a functional RNA molecule comprising a Cas12a tracrRNA and a functional RNA moiety; and
(c) optionally, a terminator 3' to and operably linked to the DNA encoding a functional RNA molecule.

38. The DNA expression system of embodiment 37, further comprising:
(d) optionally, a DNA sequence for a second promoter;
(e) operably linked and heterologous to the first promoter or the second promoter, a DNA encoding a Cas12a crRNA that comprises a 3' extension capable of hybridizing with a segment of the functional RNA molecule; and
(f) optionally, a terminator 3' to and operably linked to the DNA encoding a Cas12 crRNA.

39. The DNA expression system of embodiment 38, wherein the first promoter and the DNA encoding the functional RNA molecule, and the DNA encoding a Cas12a crRNA that comprises a 3' extension are contained in a single construct.

40. The DNA expression system of embodiment 38, comprising the second promoter, wherein the first promoter and the DNA encoding the functional RNA molecule are contained in a first construct, and the second promoter and the DNA encoding a Cas12a crRNA that comprises a 3' extension are contained in a second construct.

41. The DNA expression system of embodiment 40, wherein the first construct and the second construct are provided (a) in a single vector, or (b) in separate vectors.

42. The DNA expression system of embodiment 38, wherein the first promoter drives expression of both the DNA encoding the functional RNA molecule and the DNA encoding the Cas12a crRNA that comprises a 3' extension.

43. The DNA expression system of any one of embodiments 37 to 42, wherein the functional RNA moiety is at least one selected from the group consisting of:
(a) a nucleotide sequence for annealing to a donor polynucleotide;
(b) a nucleotide sequence for annealing to the crRNA 3' extension;
(c) a terminator sequence;
(d) an RNA aptamer;
(e) an enzymatically active RNA sequence;
(f) a detectable label; and
(g) an RNA sequence forming at least partially double-stranded RNA.

44. The DNA expression system of any one of embodiments 37 to 42, wherein the functional RNA moiety comprises RNA forming at least partially double-stranded RNA capable of silencing a gene.

45. The DNA expression system of any one of embodiments 38 to 44, wherein the Cas12a tracrRNA further comprises a 5' extension.

46. The DNA expression system of any one of embodiments 38 to 45, wherein the Cas12a crRNA is capable of complexing with a Cas12a nuclease to form a Cas12a ribonucleoprotein complex containing the functional molecule.

47. The DNA expression system of any one of embodiments 37 to 56, wherein the first promoter has a DNA sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter and wherein the Cas12a tracrRNA has a nucleotide sequence comprising a sequence selected from the group consisting of SEQ ID NOs:1, 3, 6, 139-146, 149-169, 223-240, and 241.

48. The DNA expression system of embodiment 46 or 47, wherein the Cas12a nuclease is:
(a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens* and *Porphyromonas macacae*; or
(b) a Cas12a nuclease selected from the group consisting of LbCas12a, AsCas12a, FnCas12a, and a deactivated Cas12a nuclease; or
(c) a Cas12a nuclease having at least 80% sequence identity with a sequence selected from the group consisting of SEQ ID NOs:11, 107-138, 172, 204-221, and 222; or
(d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, 1994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A; and (4) a variant ObCsm1 sequence that differs from a wildtype ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

49. An engineered system comprising:
    (a) a Cas12a nuclease; and
    (b) at least one engineered Cas12a crRNA, or a polynucleotide encoding the engineered Cas12a crRNA, wherein the engineered Cas12a crRNA comprises
        (i) at least one direct repeat sequence or fragment thereof that is capable of associating with the Cas12a nuclease, and
        (ii) a spacer sequence that is designed to hybridize with a target sequence in a eukaryotic cell,
        wherein the at least one direct repeat sequence or fragment thereof is adjacent to and 5' to the spacer sequence; and
    (c) a Cas12a tracrRNA comprising a nucleotide sequence that has at least 50% complementarity with, the nucleotide sequence of the at least one direct repeat of the engineered Cas12a crRNA.

50. An engineered system comprising:
    (a) a Cas12a nuclease; and
    (b) at least one engineered Cas12a crRNA, or a polynucleotide encoding the engineered Cas12a crRNA, wherein the engineered Cas12a crRNA comprises
        (i) at least one direct repeat sequence or fragment thereof that is capable of associating with the Cas12a nuclease, and
        (ii) a spacer sequence that is designed to hybridize with a target sequence in a eukaryotic cell,
        wherein the at least one direct repeat sequence or fragment thereof is adjacent to and 5' to the spacer sequence; and
    (c) a Cas12a tracrRNA comprising a naturally occurring putative Cas12a tracrRNA sequence that is identified from the same genomic region as the Cas12a nuclease by at least the following steps: (i) identifying in the genomic region flanking the DNA encoding the Cas12a nuclease at least one nucleotide sequence that comprises a CRISPR array including direct repeats, and (ii) identifying as a putative Cas12a tracrRNA at least one nucleotide sequence in either the sense or antisense direction in the genomic region flanking the DNA encoding the Cas12a nuclease, wherein the putative Cas12a tracrRNA has a nucleotide sequence that has at least 50% complementarity with, the nucleotide sequence of the direct repeat.

51. The engineered system of embodiment 49 or embodiment 50, wherein the engineered Cas12a crRNA, or the polynucleotide encoding the engineered Cas12a crRNA, further comprises at least one direct repeat sequence or fragment thereof capable of associating with the Cas12a nuclease adjacent to and 3' to the spacer sequence.

52. The engineered system of embodiment 49 or embodiment 50, wherein the engineered Cas12a crRNA further comprises a 3' extension adjacent to the spacer sequence.

53. The engineered system of embodiment 52, wherein the 3' extension comprises nucleotides that when base-paired form about one helical turn.

54. The engineered system of embodiment 52, wherein the 3' extension comprises at least 10 contiguous nucleotides.

55. The engineered system of any one of embodiments 52, 53, and 54, wherein the Cas12a tracrRNA has a nucleotide sequence having sufficient complementarity to the engineered Cas12a crRNA's 3' extension to allow hybridization between the tracrRNA and the engineered Cas12a crRNA.

56. An engineered system comprising:
    (a) one or more nucleotide sequences encoding a Cas12a nuclease; and
    (b) one or more nucleotide sequences encoding at least one engineered Cas12a crRNA that is designed to form a complex with the Cas12a nuclease and that comprises a spacer sequence designed to hybridize with a target sequence in a eukaryotic cell; and
    (c) one or more nucleotide sequences encoding at least one Cas12a tracrRNA.

57. An engineered system comprising:
    (a) a Cas12a nuclease, or one or more nucleotide sequences encoding the Cas12a nuclease; and
    (b) at least one engineered Cas12a crRNA designed to form a complex with the Cas12a nuclease and comprising a spacer sequence designed to hybridize with a target sequence in a eukaryotic cell, or one or more nucleotide sequences encoding the at least one engineered Cas12a crRNA polynucleotide; and
    (c) at least one tracrRNA, or one or more nucleotide sequences encoding the at least one Cas12a tracrRNA.

58. The engineered system of embodiment 56 or embodiment 57, wherein the at least one engineered Cas12a crRNA, or a polynucleotide encoding the at least one engineered Cas12a crRNA, further comprises at least one direct repeat sequence or fragment thereof that is capable of associating with the Cas12a nuclease and is adjacent to and 5' to the spacer sequence.

59. The engineered system of embodiment 56 or embodiment 57, wherein the engineered Cas12a crRNA, or a polynucleotide encoding the engineered Cas12a crRNA, further comprises at least one direct repeat sequence or fragment thereof capable of associating with the Cas12a nuclease adjacent to and 3' to the spacer sequence.

60. The engineered system of embodiment 56 or embodiment 57, wherein the engineered Cas12a crRNA further comprises a 3' extension adjacent to the spacer sequence.

61. The engineered system of embodiment 60, wherein the 3' extension comprises nucleotides that when base-paired form about one helical turn.

62. The engineered system of embodiment 60, wherein the 3' extension comprises at least 10 contiguous nucleotides.

63. The engineered system of any one of embodiments 60, 61, and 62, wherein the Cas12a tracrRNA has a nucleotide sequence having sufficient complementarity to the engineered Cas12a crRNA's 3' extension to allow hybridization between the Cas12a tracrRNA and the engineered Cas12a crRNA.

64. An engineered system comprising one or more vectors comprising:
    (a) a first regulatory element that is heterologous to and operably linked to one or more nucleotide sequences encoding a Cas12a nuclease; and
    (b) a second regulatory element that is heterologous to and operably linked to one or more nucleotide sequences encoding at least one engineered Cas12a crRNA that is designed to form a complex with the Cas12a nuclease and that comprises a spacer sequence designed to hybridize with a target sequence in a eukaryotic cell; and
(c) a third regulatory element that is heterologous to and operably linked to one or more nucleotide sequences encoding at least one Cas12a tracrRNA;
wherein components (a) and (b) and (c) are located on the same vector or on different vectors of the system.

65. The engineered system of embodiment 64, wherein the first regulatory element, the second regulatory element, and the third regulatory element each comprise a promoter that is functional in the eukaryotic cell.

66. The engineered system of embodiment 65, wherein the first regulatory element, the second regulatory element, and the third regulatory element each comprise a promoter selected from the group consisting of pol III promoters, pol II promoters, and pol I promoters.

67. The engineered system of embodiment 69, wherein the first regulatory element, the second regulatory element, and the third regulatory element each comprise a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, an EF1a promoter.

68. The engineered system of embodiment 64, wherein the eukaryotic cell is a plant cell, and wherein the third regulatory element comprises a promoter having a nucleotide sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter.

69. The engineered system of any one of embodiments 64-68, wherein the at least one Cas12a tracrRNA is at least one Cas12a tracrRNA having a nucleotide sequence comprising a sequence selected from the group consisting of SEQ ID NOs:1, 3, 6, 139-146, 149-169, 223-240, and 241.

70. An engineered system comprising one or more vectors comprising:
(a) a first expression cassette comprising at least a first promoter that is heterologous to and operably linked to one or more nucleotide sequences encoding a Cas12a nuclease and—optionally—a first transcription terminator sequence; and
(b) a second expression cassette comprising at least a second promoter that is heterologous to operably linked to one or more nucleotide sequences encoding at least one engineered Cas12a crRNA that is designed to form a complex with the Cas12a nuclease and that comprises a spacer sequence designed to hybridize with a target sequence in a eukaryotic cell and—optionally—a second transcription terminator sequence; and
(c) a third expression cassette comprising at least a third promoter that is heterologous to operably linked to one or more nucleotide sequences encoding at least one Cas12a tracrRNA and—optionally—a third transcription terminator sequence,
wherein components (a) and (b) and (c) are located on the same vector or on different vectors of the system.

71. The engineered system of embodiment 70, wherein the first promoter, the second promoter, and the third promoter are each a promoter that is functional in the eukaryotic cell, and wherein the first transcription terminator, the second transcription terminator, and the third transcription terminator are each a transcription terminator that is functional in the eukaryotic cell.

72. The engineered system of embodiment 70, wherein the first promoter, the second promoter, and the third promoter are each a promoter selected from the group consisting of pol III promoters, pol II promoters, and pol I promoters.

73. The engineered system of embodiment 70, wherein the first promoter, the second promoter, and the third promoter are each a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, an EF1a promoter.

74. The engineered system of embodiment 70, wherein the first promoter, the second promoter, and the third promoter are each a promoter with a nucleotide sequence selected from the group consisting of SEQ ID NOs:16-71 or comprises a promoter selected from the group consisting of a U6 promoter, an H1 promoter, a Rous sarcoma virus (RSV) LTR promoter, a cytomegalovirus (CMV) promoter, an SV40 promoter, a dihydrofolate reductase promoter, a beta-actin promoter, a phosphoglycerol kinase (PGK) promoter, and an EF1a promoter.

75. The engineered system of embodiment 70, wherein the first transcription terminator, the second transcription terminator, and the third transcription terminator are each selected from the group consisting of a U6 poly-T terminator, an SV40 terminator, an hGH terminator, a BGH terminator, an rbGlob terminator, a synthetic terminator functional in a eukaryotic cell, a 3' element from an *Agrobacterium* sp. gene, a 3' element from a non-human animal gene, a 3' element from a human gene, and a 3' element from a plant gene, wherein the 3' element terminate transcription of an RNA transcript located immediately 5' to the 3' element.

76. The engineered system of embodiment 70, wherein the first transcription terminator, the second transcription terminator, and the third transcription terminator are each a transcription terminator having a sequence selected from the group consisting of SEQ ID NOs: 72-99, and 100.

77. The engineered system of any one of embodiments 49-76, wherein the eukaryotic cell is a non-human animal cell, a human cell, a plant cell, or a fungal cell.

78. The engineered system of any one of embodiments 49-77, wherein the eukaryotic cell is in vitro, ex vivo, or in vivo.

79. The engineered system of any one of embodiments 49-78, wherein the Cas12a nuclease is:
(a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, Smithella sp. SCADC, *Acidaminococcus* sp. BV3L6, *Lachnospiraceae bacterium* MA2020, Candidatus Methanoplasma termi-

*tum, Eubacterium eligens, Moraxella bovoculi* 237, *Leptospira inadai, Lachnospiraceae bacterium* ND2006, *Porphyromonas crevioricanis* 3, *Prevotella disiens* and *Porphyromonas macacae*; or
  (b) a Cas12a nuclease selected from the group consisting of LbCas12a, AsCas12a, FnCas12a, and a deactivated Cas12a nuclease; or
  (c) a Cas12a nuclease having at least 80% sequence identity with a sequence selected from the group consisting of SEQ ID NOs:11, 107-138, 172, 204-221, and 222; or
  (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A; and (4) a variant ObCsm1 sequence that differs from a wildtype ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

80. The engineered system of any one of embodiments 49-79, wherein the Cas12a nuclease comprises one or more of:
  (a) a localization signal;
  (b) a detectable label;
  (c) a cell-penetrating peptide;
  (d) an endosomal escape peptide; and
  (e) and affinity tag.

81. The engineered system of any one of embodiments 49-80, wherein the at least one Cas12a tracrRNA has a nucleotide sequence selected from the group consisting of SEQ ID NOs:1, 3, 6, 139-146, 149-169, 223-240, and 241.

82. The engineered system of any one of embodiments 49-81, wherein the genomic sequence encoding the Cas12a nuclease and the genomic sequence encoding the Cas12a tracrRNA occur naturally within the same region in a genome.

83. The engineered system of any one of embodiments 49, 50, 56, 57, 64, and 68, wherein the target sequence is located 3' of a Protospacer Adjacent Motif (PAM) and the PAM sequence is TTN, where N is A/C/G or T and the Cas12a nuclease is FnCpf1, or the PAM sequence is TTTV, where V is A/C or G and the Cas12a nuclease is PaCpf1p, LbCpf1 or AsCpf1.

84. The engineered system of any one of embodiments 49, 56, 57, 64, and 68, wherein the Cas12a tracrRNA is a putative Cas12a tracrRNA that is identified from the same genomic region as the Cas12a nuclease by at least the following steps:
  (a) identifying in the genomic region flanking the DNA encoding the Cas12a nuclease at least one nucleotide sequence that comprises a CRISPR array including direct repeats;
  (b) identifying as a putative Cas12a tracrRNA at least one nucleotide sequence in either the sense or antisense direction in the genomic region flanking the DNA encoding the Cas12a nuclease, wherein the putative Cas12a tracrRNA has a nucleotide sequence that has at least 50% complementarity with, the nucleotide sequence of the direct repeat.

85. The engineered system of any one of embodiments 49, 50, 56, 57, 64, and 68, wherein the Cas12a tracrRNA is provided:
  (a) as DNA encoding a first RNA molecule comprising the Cas12a tracrRNA and comprising a restriction endonuclease cleavage site that is suitable for insertion of a sequence coding for a functional RNA moiety; or
  (b) as a functional RNA molecule comprising the Cas12a tracrRNA and a functional RNA moiety, or as a polynucleotide encoding the functional RNA molecule; or
  (c) by the DNA expression system of embodiment 18; or
  (d) by the DNA expression system of embodiment 37.

86. The engineered system of any one of embodiments 49, 50, 56, 57, 64, and 68, wherein the Cas12a tracrRNA is provided as DNA encoding a first RNA molecule comprising the Cas12a tracrRNA and comprising a restriction endonuclease cleavage site that is suitable for insertion of a sequence coding for a functional RNA moiety, and wherein the functional RNA moiety is at least one selected from the group consisting of:
  (a) a nucleotide sequence for annealing to a donor polynucleotide;
  (b) a nucleotide sequence for annealing to the crRNA 3' extension;
  (c) a terminator sequence;
  (d) an RNA aptamer;
  (e) an enzymatically active RNA sequence;
  (f) a detectable label; and
  (g) an RNA sequence forming at least partially double-stranded RNA.

87. The engineered system of any one of embodiments 49, 50, 56, 57, 64, and 68, wherein the Cas12a tracrRNA is provided as DNA encoding a first RNA molecule comprising the Cas12a tracrRNA and comprising a restriction endonuclease cleavage site that is suitable for insertion of a sequence coding for a functional RNA moiety, wherein the functional RNA moiety comprises RNA forming at least partially double-stranded RNA capable of silencing a gene.

88. The engineered system of any one of embodiments 49, 50, 56, 57, 64, and 68, wherein the Cas12a tracrRNA is provided as DNA encoding a first RNA molecule comprising the Cas12a tracrRNA and comprising a restriction endonuclease cleavage site that is suitable for insertion of a sequence coding for a functional RNA moiety, wherein the functional RNA moiety comprises an RNA sequence for annealing to a donor polynucleotide, and wherein the composition further comprises the donor polynucleotide.

89. The engineered system of any one of embodiments 49, 50, 56, 57, 64, and 68, wherein the Cas12a tracrRNA is provided as a functional RNA molecule comprising the Cas12a tracrRNA and a functional RNA moiety, or as a polynucleotide encoding the functional RNA molecule, and wherein the functional RNA moiety is at least one selected from the group consisting of:
(a) a nucleotide sequence for annealing to a donor polynucleotide;
(b) a nucleotide sequence for annealing to the crRNA 3' extension;
(c) a terminator sequence;
(d) an RNA aptamer;
(e) an enzymatically active RNA sequence;
(f) a detectable label; and
(g) an RNA sequence forming at least partially double-stranded RNA.

90. The engineered system of any one of embodiments 49, 50, 56, 57, 64, and 68, wherein the Cas12a tracrRNA is provided as a functional RNA molecule comprising the Cas12a tracrRNA and a functional RNA moiety, or as a polynucleotide encoding the functional RNA molecule, and wherein the functional RNA moiety comprises RNA forming at least partially double-stranded RNA capable of silencing a gene.

91. The engineered system of any one of embodiments 49, 50, 56, 57, 64, and 68, wherein the Cas12a tracrRNA is provided as a functional RNA molecule comprising the Cas12a tracrRNA and a functional RNA moiety, or as a polynucleotide encoding the functional RNA molecule, wherein the functional RNA moiety comprises an RNA sequence for annealing to a donor polynucleotide, and wherein the system further comprises the donor polynucleotide.

92. The engineered system of any one of embodiments 49, 50, 56, 57, 64, and 68, wherein the Cas12a tracrRNA is provided in a molar excess, relative to the amount of Cas12a nuclease.

93. The engineered system of any one of embodiments 49, 50, 56, 57, 64, and 68, wherein the Cas12a tracrRNA is provided in a molar amount that is at least 10-fold greater than the molar amount of the Cas12a nuclease.

94. A delivery particle comprising the engineered system of any one of embodiments 49, 50, 56, 57, 64, and 68.

95. The delivery particle of embodiment 94, wherein the Cas12a nuclease is complexed with the engineered Cas12a crRNA polynucleotide.

96. The delivery particle of embodiment 94, wherein the Cas12a tracrRNA is present in a molar excess, relative to the amount of Cas12a nuclease.

97. The delivery particle of embodiment 94, wherein the Cas12a tracrRNA is present in a molar amount that is at least 10-fold greater than the molar amount of the Cas12a nuclease.

98. A delivery liquid comprising the engineered system of any one of embodiments 49, 50, 56, 57, 64, and 68.

99. The delivery liquid of embodiment 98, wherein the Cas12a nuclease is complexed with the engineered Cas12a crRNA polynucleotide.

100. The delivery liquid of embodiment 98, wherein the Cas12a tracrRNA is present in a molar excess, relative to the amount of Cas12a nuclease.

101. The delivery liquid of embodiment 98, wherein the Cas12a tracrRNA is present in a molar amount that is at least 10-fold greater than the molar amount of the Cas12a nuclease.

102. A method of modifying a target sequence in a locus of interest of a eukaryotic cell comprising delivering the engineered system according to any one of embodiments 49, 50, 56, 57, 64, and 68 to the locus of interest, wherein the spacer sequence hybridizes with the target sequence, whereby modification of the locus of interest occurs.

103. The method of embodiment 102, wherein the locus of interest is within a eukaryotic cell.

104. The method of embodiment 102, wherein the eukaryotic cell is a plant cell.

105. The method of embodiment 102, wherein the eukaryotic cell is a non-human animal cell or a human cell.

106. The method of embodiment 102, wherein the engineered system or a component thereof is delivered via delivery particles, delivery vesicles, delivery liquids, or one or more viral or bacterial vectors.

107. The method of embodiment 102, wherein the engineered system or a component thereof is delivered via delivery particles comprising at least one selected from the group consisting of a lipid, a sugar, a metal, or a protein.

108. The method of embodiment 102, wherein the engineered system or a component thereof is delivered via delivery exosomes or liposomes.

109. The method of embodiment 102, wherein the engineered system or a component thereof is delivered via at least one viral vector selected from the group consisting of adenoviruses, lentiviruses, adeno-associated viruses, retroviruses, geminiviruses, begomoviruses, tobamoviruses, potex viruses, comoviruses, wheat streak mosaic virus, barley stripe mosaic virus, bean yellow dwarf virus, bean pod mottle virus, cabbage leaf curl virus, beet curly top virus, tobacco yellow dwarf virus, tobacco rattle virus, potato virus X, and cowpea mosaic virus.

110. The method of embodiment 102, wherein the system or a component thereof is delivered via at least one bacterial vector capable of transforming a plant cell and selected from the group consisting of *Agrobacterium* sp., *Rhizobium* sp., *Sinorhizobium* (Ensifer) sp., *Mesorhizobium* sp., *Bradyrhizobium* sp., *Azobacter* sp., and *Phyllobacterium* sp.

111. The method of embodiment 102, wherein the Cas12a nuclease is:
(a) a Cas12a nuclease identified from the genome of a bacterial species selected from the group consisting of *Francisella tularensis* 1, *Prevotella albensis*, *Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens* and *Porphyromonas macacae*; or
(b) a Cas12a nuclease selected from the group consisting of LbCas12a, AsCas12a, FnCas12a, and a deactivated Cas12a nuclease; or
(c) a Cas12a nuclease having at least 80% sequence identity with a sequence selected from the group consisting of SEQ ID NOs:11, 107-138, 172, 204-221, and 222; or
(d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO:134) in containing at least one point mutation selected from the group consisting of L320P, V980A, Q987N, T1004F/Q, K1035E, T1057K, D1107N, F1117Y, N1291L, D908A, E993A, and D1263A; (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A; and (4) a variant ObCsm1 sequence that differs from a wildtype ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

112. The method of embodiment 102, wherein the Cas12a nuclease comprises one or more of:
    (a) a localization signal;
    (b) a detectable label;
    (c) a cell-penetrating peptide;
    (d) an endosomal escape peptide; and
    (e) and affinity tag.

113. The method of embodiment 102, wherein the Cas12a tracrRNA has a nucleotide sequence comprising a sequence selected from the group consisting of SEQ ID NOs:1, 3, 6, 139-146, 149-169, 223-240, and 241.

114. The method of embodiment 102, wherein the tracrRNA is a putative Cas12a tracrRNA that is identified from the same genomic region as the Cas12a nuclease by at least the following steps:
    (a) identifying in the genomic region flanking the DNA encoding the Cas12a nuclease at least one nucleotide sequence that comprises a CRISPR array including direct repeats;
    (b) identifying as a putative Cas12a tracrRNA at least one nucleotide sequence in either the sense or antisense direction in the genomic region flanking the DNA encoding the Cas12a nuclease, wherein the putative Cas12a tracrRNA has a nucleotide sequence that has at least 50% complementarity with, the nucleotide sequence of the direct repeat.

115. The method of embodiment 102, wherein the eukaryotic cell comprises a cell of a cell line or a cell of a multicellular organism, and wherein the locus of interest comprises a locus of interest in the genome of the eukaryotic cell.

116. The method of embodiment 102, wherein the eukaryotic cell is in vitro, ex vivo, or in vivo.

117. The method of embodiment 102, wherein the eukaryotic cell comprises anon-human animal or human stem cell or a non-human animal or human stem cell line.

118. The method of embodiment 102, wherein the locus of interest is within a eukaryotic DNA molecule in vitro.

119. The method of embodiment 102, wherein the eukaryotic cell comprises a plant cell, and wherein the modification of the locus of interest is correlated with a modified trait in a plant comprising cells containing the modification of the locus of interest.

120. The method of embodiment 119, wherein the method further comprises obtaining, growing, or regenerating a plant from the plant cell, wherein the plant comprises cells containing the modification of the locus of interest, and wherein the plant exhibits the modified trait effected by the modification of the locus of interest.

121. The method of embodiment 102, wherein the eukaryotic cell comprises a plant cell, and the method further comprises identifying a trait of interest in a plant obtained, grown, or regenerated from the plant cell, wherein the trait of interest is effected by the modification of the locus of interest.

122. The method of embodiment 121, further comprising:
    (a) introducing a nucleotide sequence comprising the locus of interest into a plant cell, a plant cell line, or a plant germplasm, and generating from the plant cell, the plant cell line, or the plant germplasm a plant comprising cells containing the nucleotide sequence comprising the locus of interest; or
    (b) introducing the modified locus of interest into a plant cell, a plant cell line, or a plant germplasm, and generating from the plant cell, the plant cell line, or the plant germplasm a plant comprising cells containing the modified locus of interest; or
    (c) modifying expression of the locus of interest in a plant cell, a plant cell line, or a plant germplasm, and generating from the plant cell, the plant cell line, or the plant germplasm a plant comprising cells containing the locus of interest having modified expression; or
    (d) deleting the locus of interest or an endogenous nucleotide sequence comprising the locus of interest in a plant cell, and generating from the plant cell, the plant cell line, or the plant germplasm a plant comprising cells in which the locus of interest or the endogenous nucleotide sequence comprising the locus of interest has been deleted.

123. A method of editing a genetic locus with a Cas12a nuclease, comprising contacting DNA that comprises the genetic locus with:
    (a) a Cas12a nuclease; and
    (b) an engineered Cas12a crRNA that includes a spacer sequence that is designed to hybridize with a target sequence in the genetic locus; and
    (c) a Cas12a tracrRNA, thereby editing the genetic locus;
        wherein the efficiency of editing of the genetic locus is increased compared to a control method in which the DNA that comprises the genetic locus is contacted with the Cas12a nuclease and the Cas12a crRNA, but not the Cas12a tracrRNA.

124. The method of embodiment 123, wherein the Cas12a nuclease and the engineered Cas12a crRNA are provided as a ribonucleoprotein complex.

125. The method of embodiment 123, wherein the Cas12a nuclease is provided as a polynucleotide encoding the Cas12a nuclease.

126. The method of embodiment 123, wherein the Cas12a tracrRNA is provided:
    (a) as DNA encoding a first RNA molecule comprising the Cas12a tracrRNA and comprising a restriction endonuclease cleavage site that is suitable for insertion of a sequence coding for a functional RNA moiety; or
    (b) as a functional RNA molecule comprising the Cas12a tracrRNA and a functional RNA moiety, or as a polynucleotide encoding the functional RNA molecule; or
    (c) by the DNA expression system of embodiment 18; or
    (d) by the DNA expression system of embodiment 37.

127. The method of embodiment 123, wherein the DNA that comprises the genetic locus is genomic DNA.
128. The method of embodiment 123, wherein the DNA that comprises the genetic locus is in a eukaryotic DNA molecule in vitro.
129. The method of embodiment 123, wherein the DNA that comprises the genetic locus is in a eukaryotic cell.
130. The method of embodiment 129, wherein the eukaryotic cell is a cell of a non-human animal, an invertebrate, a vertebrate, a mollusk, an arthropod, an insect, a fish, a reptile, an amphibian, a bird, a mammal, a primate, a non-human primate, a human, a plant, or a fungus.
131. The method of embodiment 129, wherein the eukaryotic cell comprises a cell of a cell line or a cell of a multicellular organism, and wherein the genetic locus to be modified comprises a locus of interest in the genome of the eukaryotic cell.
132. The method of embodiment 129, wherein the eukaryotic cell is in vitro, ex vivo, or in vivo.
133. The method of embodiment 129, wherein the eukaryotic cell comprises anon-human animal or human stem cell or a non-human animal or human stem cell line.
134. The method of embodiment 123, wherein the Cas12a tracrRNA is a putative tracrRNA.
135. The method of embodiment 134, wherein the putative Cas12a tracrRNA is identified from the same genomic region as the Cas12a nuclease by at least the following steps:
    (a) identifying in the genomic region flanking the DNA encoding the Cas12a nuclease at least one nucleotide sequence that comprises a CRISPR array including direct repeats;
    (b) identifying as a putative Cas12a tracrRNA at least one nucleotide sequence in either the sense or antisense direction in the genomic region flanking the DNA encoding the Cas12a nuclease, wherein the putative Cas12a tracrRNA has a nucleotide sequence that has at least 50% complementarity with, the nucleotide sequence of the direct repeat.
136. The method of embodiment 123, wherein the Cas12a tracrRNA is provided in a molar excess, relative to the Cas12a nuclease.
137. The method of embodiment 123, wherein the Cas12a tracrRNA is provided in a molar amount that is at least 10-fold greater than the molar amount of the Cas12a nuclease.
138. The method of embodiment 123, wherein the engineered Cas12a crRNA, or a polynucleotide encoding the engineered Cas12a crRNA, further comprises at least one direct repeat sequence or fragment thereof capable of associating with the Cas12a nuclease adjacent to and 3' to the spacer sequence.
139. The method of embodiment 123, wherein the engineered Cas12a crRNA further comprises a 3' extension adjacent to the spacer sequence.
140. The method of embodiment 123, wherein the 3' extension comprises nucleotides that when base-paired form about one helical turn.
141. The method of embodiment 123, wherein the 3' extension comprises at least 10 contiguous nucleotides.
142. The method of embodiment 123, wherein the Cas12a tracrRNA has a nucleotide sequence having sufficient complementarity to the engineered Cas12a crRNA's 3' extension to allow hybridization between the tracrRNA and the engineered Cas12a crRNA.
143. The method of embodiment 123, wherein the editing of the genetic locus is effecting an indel in the genetic locus.
144. The method of embodiment 123, wherein the editing of the genetic locus is effecting non-homologous end joining (NHEJ) in the genetic locus.
145. The method of embodiment 123, wherein the editing of the genetic locus is effecting homology-dependent repair (HDR) in the genetic locus.
146. A composition for modifying a genetic locus in a eukaryotic cell, comprising:
    (a) a eukaryotic cell containing a genetic locus to be modified; and
    (b) a Cas12a nuclease, or a polynucleotide encoding the Cas12a nuclease; and
    (c) an engineered Cas12a crRNA that includes a spacer sequence corresponding to a specific sequence in the genetic locus, or a polynucleotide encoding the Cas12a crRNA; and
    (d) a Cas12a tracrRNA, or a polynucleotide encoding the Cas12a tracrRNA, wherein the Cas12a tracrRNA is provided in molar excess relative to the Cas12a nuclease.
147. The composition of embodiment 146, wherein the Cas12a tracrRNA is identified from the same genomic region as the Cas12a nuclease by at least the following steps:
    (a) identifying in the genomic region flanking the DNA encoding the Cas12a nuclease at least one nucleotide sequence that comprises a CRISPR array including direct repeats;
    (b) identifying as a putative Cas12a tracrRNA at least one nucleotide sequence in either the sense or antisense direction in the genomic region flanking the DNA encoding the Cas12a nuclease, wherein the putative Cas12a tracrRNA has a nucleotide sequence that has at least 50% complementarity with, the nucleotide sequence of the direct repeat.
148. The composition of embodiment 146, wherein the Cas12a tracrRNA is present in a molar excess, relative to the Cas12a nuclease.
149. The composition of embodiment 146, wherein the Cas12a tracrRNA is present in a molar amount that is at least 10-fold greater than the molar amount of the Cas12a nuclease.
150. The composition of embodiment 146, wherein the eukaryotic cell is a cell of a non-human animal, an invertebrate, a vertebrate, a mollusk, an arthropod, an insect, a fish, a reptile, an amphibian, a bird, a mammal, a primate, a non-human primate, a human, a plant, or a fungus.
151. The composition of embodiment 146, wherein the eukaryotic cell comprises a cell of a cell line or a cell of a multicellular organism, and wherein the genetic locus to be modified comprises a locus of interest in the genome of the eukaryotic cell.
152. The composition of embodiment 146, wherein the eukaryotic cell is in vitro, ex vivo, or in vivo.
153. The composition of embodiment 146, wherein the eukaryotic cell comprises a non-human animal or human stem cell or a non-human animal or human stem cell line.
154. The composition of embodiment 146, wherein the Cas12a tracrRNA is provided:
    (a) as DNA encoding a first RNA molecule comprising the Cas12a tracrRNA and comprising a restriction endonuclease cleavage site that is suitable for insertion of a sequence coding for a functional RNA moiety; or
(b) as a functional RNA molecule comprising the Cas12a tracrRNA and a functional RNA moiety, or as a polynucleotide encoding the functional RNA molecule; or
(c) by the DNA expression system of embodiment 18; or
(d) by the DNA expression system of embodiment 37.

155. The composition of embodiment 146, wherein the Cas12a tracrRNA is provided as DNA encoding a first RNA molecule comprising the Cas12a tracrRNA and comprising a restriction endonuclease cleavage site that is suitable for insertion of a sequence coding for a functional RNA moiety, and wherein the functional RNA moiety is at least one selected from the group consisting of:
(a) a nucleotide sequence for annealing to a donor polynucleotide;
(b) a nucleotide sequence for annealing to the crRNA 3' extension;
(c) a terminator sequence;
(d) an RNA aptamer;
(e) an enzymatically active RNA sequence;
(f) a detectable label; and
(g) an RNA sequence forming at least partially double-stranded RNA.

156. The composition of embodiment 146, wherein the Cas12a tracrRNA is provided as DNA encoding a first RNA molecule comprising the Cas12a tracrRNA and comprising a restriction endonuclease cleavage site that is suitable for insertion of a sequence coding for a functional RNA moiety, wherein the functional RNA moiety comprises RNA forming at least partially double-stranded RNA capable of silencing a gene.

157. The composition of embodiment 146, wherein the Cas12a tracrRNA is provided as DNA encoding a first RNA molecule comprising the Cas12a tracrRNA and comprising a restriction endonuclease cleavage site that is suitable for insertion of a sequence coding for a functional RNA moiety, wherein the functional RNA moiety comprises an RNA sequence for annealing to a donor polynucleotide, and wherein the composition further comprises the donor polynucleotide.

158. The composition of embodiment 146, wherein the Cas12a tracrRNA is provided as a functional RNA molecule comprising the Cas12a tracrRNA and a functional RNA moiety, or as a polynucleotide encoding the functional RNA molecule, and wherein the functional RNA moiety is at least one selected from the group consisting of:
(a) a nucleotide sequence for annealing to a donor polynucleotide;
(b) a nucleotide sequence for annealing to the crRNA 3' extension;
(c) a terminator sequence;
(d) an RNA aptamer;
(e) an enzymatically active RNA sequence;
(f) a detectable label; and
(g) an RNA sequence forming at least partially double-stranded RNA.

159. The composition of embodiment 146, wherein the Cas12a tracrRNA is provided as a functional RNA molecule comprising the Cas12a tracrRNA and a functional RNA moiety, or as a polynucleotide encoding the functional RNA molecule, and wherein the functional RNA moiety comprises RNA forming at least partially double-stranded RNA capable of silencing a gene.

160. The composition of embodiment 146, wherein the Cas12a tracrRNA is provided as a functional RNA molecule comprising the Cas12a tracrRNA and a functional RNA moiety, or as a polynucleotide encoding the functional RNA molecule, wherein the functional RNA moiety comprises an RNA sequence for annealing to a donor polynucleotide, and wherein the composition further comprises the donor polynucleotide.

161. A method of making the composition of any one of embodiments 146 to 160 comprising combining in a vessel:
(a) the eukaryotic cell;
(b) the Cas12a nuclease, or the polynucleotide encoding the Cas12a nuclease;
(b) the engineered Cas12a crRNA that includes a spacer sequence corresponding to a specific sequence in a genetic locus to be modified, or the polynucleotide encoding the Cas12a crRNA; and
(c) the Cas12a tracrRNA, or the polynucleotide encoding the Cas12a tracrRNA.

162. The method of embodiment 161, wherein (a), (b), and (c) are combined in a vessel and further combined in the vessel with a eukaryotic cell.

163. The method of embodiment 161, wherein (a), (b), and (c) are combined in the eukaryotic cell by transfection-mediated delivery, magnetic particle delivery, or particle delivery of (a), (b), and (c) into the eukaryotic cell.

164. The method of any one of embodiments 102-122, wherein modification of the locus of interest occurs at a greater frequency compared to a control method, wherein a control engineered system identical to the engineered system except for the absence of the Cas12a tracrRNA is delivered to the locus of interest.

165. A method of modifying a target sequence in a locus of interest of a eukaryotic cell comprising delivering the engineered system according to embodiment 92 or 93 to the locus of interest, wherein the spacer sequence hybridizes with the target sequence, whereby modification of the locus of interest occurs at a greater frequency compared to a control method, wherein a control engineered system identical to the engineered system except for the absence of the Cas12a tracrRNA is delivered to the locus of interest.

166. A method of producing a eukaryotic cell comprising a modification of a genetic locus of interest comprising (i) delivering the engineered system of any one of embodiments 49 to 93 to a locus of interest, wherein the spacer sequence hybridizes with a target sequence located in the locus of interest of the eukaryotic cell and whereby the engineered system introduces the modification into the locus of interest.

167. The method of embodiment 166, further comprising isolating the eukaryotic cell comprising the modification of a locus of interest.

168. The method of embodiment 166 or 167, further comprising propagating the eukaryotic cell comprising the modification of the locus of interest.

169. The method of embodiment 166, 167, or 168, further comprising introducing the eukaryotic cell comprising a modification of a locus of interest into a subject, optionally wherein the subject is a human or non-human mammal.

170. The method of any one of embodiments 166 to 169, wherein the engineered system is delivered to a locus of interest in an unmodified eukaryotic cell obtained from a subject and wherein the eukaryotic cell comprising the modification of the locus of interest is introduced into the subject, optionally wherein the subject is a human or non-human mammal.

171. The method of any one of embodiments 166 to 169, further comprising regenerating the eukaryotic cell comprising a modification of a locus of interest into an organism comprising the modification of the locus of interest.

172. The method of embodiment 171, wherein the organism is a plant, optionally wherein the plant is a maize, soybean, wheat, rice, cotton, or *Brassica* sp. plant, and optionally further comprising propagating the plant or harvesting seed therefrom.

173. The method of any one of embodiments 166 to 172, wherein the modification in selected from the group consisting of an insertion of one or more nucleotides, a deletion of one or more nucleotides, or a substitution of one or more nucleotides 174. The method of any one of embodiments 166 to 173, wherein the eukaryotic cell is a non-human mammalian cell, a plant cell, or a fungal cell.

175. The method of any one of embodiments 166 to 173, wherein the eukaryotic cell is an isolated cell an in vitro axenic culture.

176. The method of embodiment 175, wherein the isolated cell is a human cell.

All cited patents and patent publications referred to in this application are incorporated herein by reference in their entirety. All of the materials and methods disclosed and claimed herein can be made and used without undue experimentation as instructed by the above disclosure and illustrated by the examples. Although the materials and methods of this disclosure have been described in terms of embodiments and illustrative examples, it will be apparent to those of skill in the art that substitutions and variations can be applied to the materials and methods described herein without departing from the concept, spirit, and scope of the invention. For instance, while the particular examples provided illustrate the methods and embodiments described herein using a specific plant, the principles in these examples are applicable to any plant of interest. All such similar substitutes and modifications apparent to those skilled in the art are deemed to be within the spirit, scope, and concept of the invention as encompassed by the embodiments of the inventions recited herein and the specification and appended claims.

SEQUENCE LISTING (243 sequences)

SEQ ID NO: 1 - RNA, 84 nt, Unknown
  Lachnospiraceae bacterium ND2006
acuuauacuaaauuuuaacuguauacuuucccaaaauaccauaggcucucugaaucucuuaacccagauuccaagggcuuuuuu

SEQ ID NO: 2 - DNA, 84 bp, Unknown
  Lachnospiraceae bacterium ND2006
acttatactaaattttaactgtatactttcccaaaataccataggctctctgaatctcttaacccagattccaagggctttttt

SEQ ID NO: 3 - RNA, 65 nt, Unknown
  Lachnospiraceae bacterium ND2006
aauugcaaaucuuugaaauaaugcagacuuaaauuuauaaauucauggaauaaggugauuuuauu

SEQ ID NO: 4 - DNA, 65 bp, Unknown
  Lachnospiraceae bacterium ND2006
aattgcaaatctttgaaataatgcagacttaaatttataaattcatggaataaggtgattttatt

SEQ ID NO: 5 - DNA, 36 bp, Unknown
  Lachnospiraceae bacterium ND2006
atctacacttagtagaaattatttaatctttgaaac

SEQ ID NO: 6 - RNA, 72 nt, Unknown
  Acidaminococcus sp. BV3L6
cauugucuaaccugcaaaccuccaacuuacuauugcuaaggaguauauauuuuguauaaaaggucuuuuuuc

SEQ ID NO: 7 - DNA, 72 bp, Unknown
  Acidaminococcus sp. BV3L6
cattgtctaacctgcaaacctccaacttactattgctaaggagtatatattttgtataaaaggtcttttttc

SEQ ID NO: 8 - DNA, 35 bp, Unknown
  Acidaminococcus sp. BV3L6
atctacaagagtagaaattaaaaaggtcttttgac

SEQ ID NO: 9 - DNA, 128 bp, Unknown
  Lachnospiraceae bacterium ND2006
aattgcaaatctttgaaataatgcagacttaaatttataaattcatggaataaggtgattttattgtgaaaaaatactcgtattttgttggaaaaacatctttttgttgtataatatgatgatatacg

SEQ ID NO: 10 - DNA, 141 bp, Artificial sequence
  Synthetic construct
gttttagagctaggccaacatgaggatcacccatgtctgcagggcctagcaagttaaaataaggctagtccgttatcaacttggccaacatgaggatcacccatgtctgcagggccaagtggcaccgagtcggtgcttttt

SEQ ID NO: 11 - protein, 1246 aa, Artificial sequence
  Synthetic construct
MLKNVGIDRLDVEKGRKNMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 12 - DNA, 72 bp, Artificial sequence
  Synthetic construct
gtttcaaagattaaataatttctactaagtgtagattggacagagctccaagtgaccaaaaccgtatatcat

SEQ ID NO: 13 - DNA, 678 bp, Zea mays
atagagagagaagaggggtcgtgtagtagtgcttaaactgtacatgaacagcagtagtgttacagaagctaaactcaaccagagctccaccaaagacaaagagggtctacttccatcaccgtcttgctcggtcacttggagctctgtccataaattaaacccatcgtggcatatctgtaggcatctaccccgtcttcgtcgtccgttcctcactagctaccaagaggtcgccattattgccaacatagagtgtacgtggatgtctatatatatgcctacttgcacccatatggcataggcgttcgatccccttagcgcggaggagagctcctccggttcttctctacccttcgcatggaagttcttgcattgcttcgttgcttctctagtttcttccttctacgtctttccagcatacgcatgcccctcgtccgccggttcacgaggcatcgtctgatgatcagtagataataagcaatataatactgatctagaatcgagttgttgtactcttcgcagataggttcgttccttcacatagaagcgagtacagactacagaccacacagtatcagctggcacgaaacgaaaatggttacttgcaaattgcatgcacgagctagaattatattcttctaatcttcttcgttgactttctggcttcagcaggcgcgtgat

SEQ ID NO: 14 - DNA, 1422 bp, Artificial sequence
  Synthetic construct
atggcttcaaactttactcagttcgtgctcgtggacaatggtgggacaggggatgtgacagtggctccttctaatttcgctaatggggtggcagagtggatcagctccaactcacggagccaggcctacaaggtgacatgcagcgtcaggcagtctagtgcccagaagagaaagtataccatcaaggtggaggtccccaaagtggctacccagacagtgggcggagtcgaactgcctgtcgccgcttggaggtcctacctgaacatggagctcactatcccaattttcgctaccaattctgactgtgaactcatcgtgaaggcaatgcaggggctcctcaaagacggtaatcctatcccttccgccatcgccgctaactcaggtatctacagcgctggaggaggtggaagcggaggaggaggaagcggaggaggaggtagcggacctaagaaaaagaggaaggtggcggccgctggatccccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggaggaggtggaagcggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctga

SEQ ID NO: 15 - DNA, 138 bp, Artificial sequence
  Synthetic construct
atggatgctcttgacgattttgacctcgatatgctcgacgctcttgatgattttgatctcgacatgctcgatgcacttgatgactttgaccttgacatgctcgacgcactcgatgacttcgacctcgacatgctttag

SEQ ID NO: 16 - DNA, 400 bp, Triticum aestivum
ggcggcagggagagttttaacattgactagcgtgctgataatttgtgagaaataataattgacaagtagatactgacatttgagaagagcttctgaactgttattagtaacaaaaatggaaagctgatgcacggaaaaaggaaagaaaaagccatacttttttttaggtaggaaaagaaaaagccatacgagactgatgtctctcagatgggccgggatctgtctatctagcaggcagcagccctaccaacctcacgggccagcaattacgagtccttctaaaacgtcccgccgagggcgcgtggccgtgctgtgcagcagcacgtctaacattagtcccacctcgccagtttacagggagcagaaccagcttataagcggaggcgcggcaccaagaagc

SEQ ID NO: 17 - DNA, 299 bp, Agrobacterium tumefaciens
gatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgca

SEQ ID NO: 18 - DNA, 899 bp, Zea mays
tgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctct

SEQ ID NO: 19 - DNA, 2243 bp, Solanum lycopersicum
atcgtatccagtgcaccatattttttggcgattaccactcatattattgtgtttagtagatattttaggtgcataattgatctcttctttaaaactaggggcacttattattatacatccacttgacacttgctttagttggctattttttttattttttattttttgtcaactaccccaatttaaattttatttgattaagatatttttatggacctactttataattaaaaatattttctatttgaaaaggaaggacaaaaatcatacaattttggtccaactactcctctctttttttttttggctttataaaaaaggaaagtgattagtaataaataattaaataatgaaaaaaggaggaaataaaattttcgaattaaaatgtaaaagagaaaaaggagagggagtaatcattgtttaactttatctaaagtaccccaattcgattttacatgtatatcaaattatacaaatattttattaaaatatagatattgaataattttattattcttgaacatgtaaataaaaattatctattatttcaatttttatataaactattatttgaaatctcaattatgattttttaatatcactttctatccatgataatttcagcttaaaaagttttgtcaataattacattaattttgttgatgaggatgacaagatttcggtcatcaattacatatacacaaattgaaatagtaagcaacttgattttttttctcataatgataatgacaaagacacgaaaagacaattcaatattcacattgatttatttttatatgataataattacaataataatattcttataaagaaagagatcaattttgactgatccaaaaatttatttatttttactataccaacgtcactaattatatctaataatgtaaaacaattcaatcttacttaaatattaatttgaaataaactatttttataacgaaattactaaatttatccaataacaaaaaggtcttaagaagacataaattctttttttgtaatgctcaaataaatttgagtaaaaaagaatgaaattgagtgatttttttttaatcataagaaaataaataattaatttcaatataataaaacagtaatataatttcataaatggaattcaatacttacctcttagatataaaaaataaatataaaaataaagtgtttctaataaacccgcaatttaaataaaatatttaatattttcaatcaaatttaaataattatattaaaatatcgtagaaaaagagcaatatataatacaagaaagaagatttaagtacaattatcaactattattatactctaattttgttatatttaatttcttacggttaaggtcatgttcacgataaactcaaaatacgctgtatgaggacatattttaaattttaaccaataataaaactaagttatttttagtatatttttttgtttaacgtgacttaatttttcttttctagaggagcgtgtaagtgtcaacctcattctcctaattttcccaaccacataaaaaaaaaataaaggtagcttttgcgtgttgatttggtacactacacgtcattattacacgtgttttcgtatgattggttaatccatgaggcggtttcctctagagtcggccataccatctataaaataaagctttctgcagctcattttttcatcttctatctgatttctattataatttctctgaattgccttcaaatttctctttcaaggttagaatttttctctattttttggtttttgtttgtttagattctgagtttagttaatcaggtgctgttaaagccctaaattttgagtttttttcggttgttttgatggaaaatacctaacaattgagttttttcatgttgttttgtcggagaatgcctacaattggagttcctttcgttgttttgatgagaaagcccctaatttgagtgtttttccgtcgatttgattttaaaggtttatattcgagtttttttcgtcggtttaatgagaaggcctaaaataggagtttttctggttgatttgactaaaaaagccatggaattttgtgtttttgatgtcgctttggttctcaaggcctaagatctgagtttctccggttgttttgatgaaaaagccctaaaattggagtttttatcttgtgttttaggttgttttaatccttataatttgagttttttcgttgttctgattgttgtttttatgaatttcctgca

SEQ ID NO: 20 - DNA, 1327 bp, Arabidopsis thaliana
gtcgagctgcaggtcaacggatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaacacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagg

SEQ ID NO: 21 - DNA, 872 bp, Glycine max
tccctaattaatgtgatattgggaaagatacgtatgcaaagagaatggtaattaatgtgagatgaaactgaaaaatgacaaatgagaaatattggaaaaatcacacgttgaatgaacgtgagtatatgcatgtagaattagcaggataatgtaattcaaaatggacgaaaaatgtagaatggagaacttattcgctttattaataaaacaaaattaatttacgcatgcattgaggaagacaaaagttaaccgaatccaccctaattaatgtgatattgagaaagatttttgttttttggttaatatgatattggaaaagatacgttgaaaatataatggtaattaatgtgagaagagactaaaagatgacaaatgagaaatattggaaaagtcacgcgttgaatgaacgggaatataatgcaaaatagacgaaagatgtagaatagagaacttatttgctttattaataaaatatgaatttagttaaatttgacctaaattgggccatgtacaaattgtacacaaatatacactaagcatagaaacgaaaatataatatattatttcggaattttgaacaatattttccaaattttcaataagcaataacattcaaccacgaattctatttgtttggtcatgacgtctttagaggccacgcatttgactcctagaatattctggacccaccgtaacaactatccgttacttttcttaatccctaatctttcaagagttctggattcttctattcgccctatataaacaacccccttttcttcgtgcttcattcatctcaatcgcaatctctcaatcgttttctacataatacaaacctctctaatttttgaagctaattatacccaatctcg

SEQ ID NO: 22 - DNA, 1427 bp, Glycine max
aacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttctgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcactcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacag

SEQ ID NO: 23 - DNA, 1294 bp, Glycine max
tccattattcgggatttagcaaattgtttgtttcttcaatatttgattgaatactaatttaaaactaaaataagagagcgtgacaaatcaaaaatatagtgtgttatataatgtttccgtgcaggagatcatataggaccactagttgttaatcttagtcacaaaacaatacatgtcttgcaaagaaaaaatcgtagacataatctgttacatttttgttagaaaagttttgttcagcaaaatgttttcatttaactcgatttgatatgctgtggttttggtatttttacacacagtagttttttttttaattattgttaagcgaatttaaaatagttattattattattaagaggcttttaaatactgaaggtgtaaaaaaaatgcttcaattactttaaaactttagacatcttaattttaaccaaaatatggagctaaaaatgaatcacgaagaaagtatgaaagaattcctccatttttttagcattttattttgtctttaaaaataagaaataaagtaatattttaaaaattattagccagagtaaaaaaaatttattaaggctctttatatttacatttttttaaatcattaataatattcctaaagtctcttatctatgcaagatttagagtgtaatattttttaatttatgtgattaaacaagtgaagttaatgaattattgaactcttaaatactcctaatttataggtattgagtgttcaaggtgttgaataatccattaatttcaaccaaccaaaatattttgatctaaattttattattatttgagtagaattcaaccacattcaaagttgttttcttatgttagagtaacaactttttttttttttttctaaatactcataaatctaatgactcaattcattcacatgacactttattttaattatgatgttcaatttcttagaaaattcgaagtttaactttttggagaccaaatttaaatcaacatgttattaattgtatttgacagaaaaaagcttaaaccaaacccattccaaactaaaacattttaattggttttggtaatgaatgagtttagttaaagtcaacctaaatttgcaatgtacgcgtttgcgtcgccgtcattagaggccagaattgactcctagaatattctagacctaccctaacaactatccgttacttttcttaatccctaatatttcaagagttctagattcttctattcgccctatataaacaacctcattctcgattgcttcctacaccactaaaatatctctctattattctcgttttca

SEQ ID NO: 24 - DNA, 1176 bp, Glycine max
caagcagaacactgagacatagaggaggattgaagtgcagaaaatatatattacctctattctaaaataagtgtcacattttgataaaataaatcgttttttattaaatacactccaattcttggatttcttggaattctccaaaaaaaaaaagagattgtgagatatattaaaaaggtcaataaatcttaaaaaatatttagttttaaaataaatttaaaataaatttaaaatattgttagaatgtttatcatcttattagttggcgacggataaaaaaatgctattagttgccgaaaaggactcataagccagttgccctgtcaacgtgggctcgtggttccaattcgtccacgtgtcacaacgtgattgaaagaggtgcctttgcgttgctataaaagcgaagcccacaccaaaatcatcatcaatccaaatatttaatcctatcctatcgtagcaaagaaagaaagaaagaaaaccctagcttaccttttcaactttcaaggtaccttctgctcctcttctgttttcgattaagatttcggttgttagggttttatgctttttttttttatcgatcatcggacctgtcgagctatttgaattttgatctggattttttttcgtgtctttgattttaccgtctatataattacgcaacctggtatccgttttgaaacttttgttgattatttggctttgtttcaaattatttgttgattgaaagtgatcctgatgttatgaggttatatatttaatttgtcagaacttggggcatgtattgtgtattgtatacaggtaaaatctctattgtttagatttgttaaaggtattttcctcgtctattttggatatcaatctgattgatttatttattggaatcgagttatcaaaagcgttgttgtatttttgttttgtcctggctttaattctgtctatgttgtatatcactgcacatgtagttttgtaacttggttttccttgttatattgtttgggagggtttgatggactaatttttcaatttttttaagctgtaaatataatgttggataattttgctttcagttctctgatttgtattgtctttccattctctgttcatgaacattttaatggttatgataaagagttggtgactgattcatttattttgttgactgtattgtatatgtag

SEQ ID NO: 25 - DNA, 1427 bp, Glycine max
cataccattgagatccttgttgagtgtttgagtcctcaatcctcagcaaccaatctcaacaaatccacatggcttacgattggttccttgcccttgcctttctccatggagagaaaaacgtttccatctcgataaaaaagatagaggtaatacgagagaaggttaatacgagagacagaaaatgaaatatttgaagagatactcatttttattaattgcatggaatgagaagagtggatggacgatgtatggaaaataggtttttctactaatgaagttgacaatatataaatgacagaattaaaaaatatattattaatagattagttggtgacttataaataagatcaaatatttcttatagaaggtgatcaatatataagatcggacggaatacactttaaaaaaagattaaaaaaatattttgtgaattcaaaagaattaaaagacaaatttaaatttaaagtattaaaaaattattcataattaatggattaaaaacatatttaagaaaaaataaaaattataacaaagagataaatttaggttttaggtggcagaaaagcattttgtcatcgacgacgttagaagcaaaatgtagaatcttccggaccattgtagaaacgtaatccttatcttgccgtgcgtgtcaatgaccaccaccgtacacgtggcaaatcttaattcgttcagtttcggatattttcgtcattgagacatcgcaccaagctataagtacgaccccttctacctctaattcatgcatagcaattcccaattcctaattgtttaaacctaattctcatttcttcatcgttcgattcttctcctcctaaaggtacggctctggtttcctctctctcttgttcattcttttcgtaatagcaaccttattagccttcgtttattgatttttctcctaattacacttcaattttttcgatttgtgtttgttacgtcaatctgtatatcttttttgttgtcgtcgaatccgaaacttttcattcgcctttctgattccgtaaatcgtttgttaagtgcaacatctttccctgttcttaggtatctgattgatttctctctttctttttttttttatcagttttgaggaattagggttcgtgatctgatttgtttctttaaaatttccccggttcttaattaggctctgcgatttaatttcttttatcatatttgaagaatcatggttctttcttggtttgatttattgtgcactcagtttctgatatgcaaaatctttccctgttttaattaaggtttagggtttgcgagttgtcattttggaaaatagggtttgtggtttattgattgtgtaatccgtttggttgtaagcagaaacttctctgttttaaatcattgtttgtgatttagctctattttttatggttctgtttgtgattgaacag

SEQ ID NO: 26 - DNA, 502 bp, Nicotiana tabacum
gggatcttctgcaagcatctctatttcctgaaggtctaacctcgaagatttaagatttaattacgtttataattacaaaattgattctagtatctttaatttaatgcttatacattattaattaatttagtactttcaatttgttttcagaaattattttactattttttataaaataaaagggagaaaatggctatttaaatactagcctattttatttcaattttagcttaaaatcagccccaattagccccaatttcaaattcaaatggtccagcccaattcctaaataacccacccctaacccgcccggtttccccttttgatccatgcagtcaacgcccagaatttccctatataattttttaattcccaaacacccctaactctatcccatttctcaccaaccgccacatagatctatcctcttatctctcaaactctctcgaaccttcccctaaccctagcagcctctcatcatcctcacctcaaaacccaccgg

SEQ ID NO: 27 - DNA, 2243 bp, Solanum lycopersicum; identical to SEQ ID NO: 19

SEQ ID NO: 28 - DNA, 1833 bp, Pyrus communis
ttataataactttaaccgtttgattaaatttcaatggtctggatctccagatttgatagactggaaggaatggatccagagatgatccctttccttcttttggcaccacctcaatggctaatcttgtttaatacctaatactaaattttgctctgattaatcgaaggtccttgcaatacacgcatacatcatattcaattgctataaaaaataaaatacaaatttgtttatcttaaattcttaatcatgatagtatttatattagaaatacaatgcaaatgaagtttcaacacttataaacaacatgaaatggtgcacaaccttttaaactaatataaatgaaagttgtaactggcgcgaaagaagtcgaggagtcaggattttcaaataattgagtcatgttttcgataaaaaaattttattagatatttcgtcgagcacttgttctacatgtcgattttttacaacatttcttaaaggcttatgccaatatatgtcaataactactattatatgtagagtcaaatatggctatatagaatttacagtaatattaagaatggtagaacttgtcatcggagcatttcgtcaagtatttagtgcgcacaataggttagatggcctaatacgaattattggtgattagtgatcgtaataattcgaagggcaagtggacagaaaagtataaatactcaaggaaattgttattggcactccaaaaatctcattttactctacttataaatgtataataagatttttgaagtactacttctcatactcaatctcgaagataacgccgtaagggccccgtgaaggaggaagtcatttgagatcacggactttgatattatcaaagaaggggactagataccaggctttgccgtttaacccgcgccatcggcacgtcattccatccacgtgtcgctaaataagtggacctcctcgtcacgccaactacaattccgtgacgaagtcgccttctctaacgctataaatccaggcatcagcctctccccttcctcacaattgcgattgttttgcttctcaacaatctgaaaaatcctcctctaaatctctctcgaagctccctcagcctttcaaggtgtgttctttttttcttgtttcttgttaatttcttgtttggttgctaggaaagtgtaggaaaattggagattctgtatttgatttggttgatgtttgagatttatgattaatcggttggatctgttaaatttagcattgttttggcttttgatgttagggtttttttatttattggatgcgaaattagtaacttggaaagaaaatttgcgtcgaatcttgtgttcaattttcacgaattaggggttttgtgtattttatctaaatgatcagcatgtcttttcgaattgaaagtaaatttctttgtatcaattttgacaagtaggttttattctgtatccgatatcgaaattgagatttgttaatggtcaatttaattttgctatttatttttattccaaaattgagtaattttagactaaaattgtgtctttgatctgtgatttaaagctaaagcagggtttttttttcctttacctgatttgctgaaattcaatttgcaatcttgatcttgaattgatttattgtatataaatggctgttaatattttgtttatataaaaattgggattttcttgaatttctttgatttctgatgcattagtttccaaattaggggtttttttttttttttttttttaatctgattttcttatctgtaattcttaattttaatctaaagggatttgtttttttatgcttaatcttatggtattttggtttctgtag

SEQ ID NO: 29 - DNA, 1631 bp, Beta vulgaris
atatgtagccctaagggctatgtatatcattttcctagatttattatttggttgtgcaatttggtctatttagataaaattgagtctatgagacacgggttaagaaatacttgacatacatttatttagtttacatatatatacaccaattacacgcttggtaactagtcagacaacccatttactccctggcccctgcggtctgtacccgtttcttttgcacaaagtttcaggagaaataatgttgtgggacataaaaagatagagaaactattattttatattaaagtatgtgattacattccaaaactagaataaaaagaaatgaataaactaattaaaaacatctcaaaaaagaatacggataaactaataaagaccgaaactagtactccctccgtcccaaaatatagttcccattacccattttttacggtaatttatgcaagtagaatctaagagggataacaaagattttttgtttatttaaataaatgttgtatggaaaaagatgattttaggagagagaatggagaatgattggtgggagagcattaattgtaacattttggttgaataaacaaaggaaaaaacaaaattcaagaagcaaataaatgatgggacacgatttttctaggtaaattacggaaaaatgtgaaactaaatatgaaaatgagaactatatttttggacacttaaaatggaaataggaactatattttgggacggagggagtaataaataacgacttggtcgtctaccgttccagaccgtcagattaaaccctcaccataaatcttgtaggtagcacgtactatataatttcacaagttcgagaagtcgtgagaatctccgtctctagttgaaccgcctcaaaagcaaagaaaagtagctttacccgtgagggctaggtcaagacacgtcatacatcacacgtgtcaaacgatgattggtaaactagagataattgtcttaattaagtcggtcaaacaagtctttaaatacagcctattcccttcattggtttctcatccttcatttgaacgtaaacgatcattcatttttctctctcctctctttcaaggtaaattcctaatttccttttctctcttctcagttttcttcgtaaattttcatctcatttctgtgtaagataacaagatccaatttagttagtgtaagattgatttatctaagaaattcatttggaattttgttctttttgattttcaatttctcaggattttgtcgacaaaaaattaatcaaattttgtgtttttcagtttcatatagatctttcttgtgttgttgaaatacagatctgatcattgttacaatttctaaaatttaggtttgaaaattcgccataatttctcgtacttctgcaatcgattgatttttaattcggaaaaattagtgttaaagatatcgccataatttatcacaattctgcaatcgattaaattttcgatctggaaaaatctagggttaaaatctcgccagaatttatcgcaattctccaatcgtttaatttctgatttagtgtattctagggttaaagatctcgtcataaatttttcaaaatttcgtaaattgatgtgatttctgatccttttctttcgattttgtag

SEQ ID NO: 30 - DNA, 1441 bp, Unknown
  Raphanus raphanistrum
taaaagtacaacaactttttttttaggaaacaacaacttagctaacatatgtaacaaaattgcaaactgagctatctatctaatctgaaactgctgcacttcttgccactaaactatctcaggaaacccaacttagtctgtaagaagaaccatcaacgaacaaaactattcgaagaggctttcattgactgaataaacccgatatcttagaaatgggccaagcccaaaaaagtccgtttgatgtgtgataccgaatccattgccttcagcccatttgccaacttgataccaaaatcatgcaaatatccaaaaccactaaaaaaagaaaaaaacattatgttatttttcaggaaatttcctctattaattgtttgaagaaaaaaaaacaatttgccaacttgataccacaatcatgcaatatccaaaacgactaaaaataaaaaacattatgttattttcaggaagattccttttttatttttaaaattcaaaattaaaaaccccacctgcatagaaaaagggaaaattaaagaaaagaaaagataagagcatcgacatagggggaccatgggctcaattattggcatttttttagctccaccgttgattaaaaaaaaaaagaaagataataataacaccgatcgtaacgatccgttaaatcacaacgtcggcttctgttacggcccgttagaaactgtggttgtcgtggagttagtaaagaaacggcgttaaaatagaatgcagccaacacacgacgggtcgtgggggttatcaactcaaagcacaaaatatatacttttcctttatacctaaaaaaatcaaaggcgaaggaaagattatcttttccattaaaaggttgcgtgtaaccaacgctgaatacacgtcatttaacatacgtgtcgaaatcctattcgctattgcttcaccgccataggtttctcgtgaccgagtcctcctcatcctcttgtataaatcaaaccctaaacacctcttctccttcacaaatcgaaaaccaattcttctcaattctcaattctcaattctcaattctcaattctctctctctcgcgaattacgatcaaggttagattcgtgtttcttcttctctcgattagctgtttcgttcgatcgtaattgattaagccccgatagatctcgtcgtgattttgattattagggttcaattgttacgattaaggtttgattctggtttcttcttcatcgattagttgtttcattcaatcgtatatgtattttcgaatttgaatcggtttgttgagattaaacgatagaactcgtcgtgatttttgatttttccagatttgtgttggctacttgatcatatatgatccgtgtttgtatattgtagcgatctctttgtattgatttcgcaattgatccgagtcaaaagagtattgatcttggcttttgtgaattacag

SEQ ID NO: 31 - DNA, 1394 bp, Ipomoea nil
attagggaaaatagcactttttccccctaagttatatacttatagcattttttccccctcaattatttatgtaagtacattagccccctcaattattttaaaagtggtggtttttccccctgatatattaaattgacatttctacccttaaagtaaacattttatttttttacttctccaacaaattattgtgtatatgtagcaatgaccacggttcggttcgaactaaaccgcacactatagcaatcgaattaaaacttttcggttataattcagatctagaatccaatatttgaatttcaatttattaaatttatgaaccaaaaaaactggatcatgaaccgtgaaccggcgattatagatccggttcgcaattttgaaccgtctttattttaaaattttattttattttttattttaaaatagtctaaattcaacaataaatgtaatttattttttcagttcggaacatgaactggccattccggtttgcgattttaataaactctaaatatcgcattttgattctaaattgtaattggaatattttggtttggttggtatagtatctgtttggtttgaaccaaattatagtaataatttgttggagaagaaaaataaatgaaatatttattttaagagtaaatatgtccatttaatattttagggggaaaagaaccacttaaataattcaaggagaaaaagtgctataagtatataactcagggagaaaaagtgtcattttcccttattatatatatatatatatatatatataaataaaaaaatgaatagtataaaacaaatttataaattttgccggatcggataattatgaagcgcgtaggttttgaagtcaaaatcggctacttgccaaattgcaatttccgaacctaataatctccaccacgcaaagaaaatccgacaaataatgcaagccgttgcgtgtggtattgatcaatacacgtaatatccaacacgtgtccctccttcataggtcaacaagataagcactttcttcgcaaggcggtcgagacacgcctttataatcttctcctccctcgccctttctcatccatcatacgatttctctattctatccaaatttcttcctcctcaaaaccttctctcaaggtaaccacagttttctcaatcttccttcctttttgtttattgttattattgttaatgttaattgttaattttctgtgttattcttattcgtgattcgtgaattggggatctgggggttgtgttctttgatcttcataaattgcaattggttttagggttttttttttttttttttttttttggattgaattggtgttaattgaggatgttttatgtttgtatttgatggttaatttgattttgtatttggatatatacag

SEQ ID NO: 32 - DNA, 1438 bp, Unknown
  Cucurbita sp.
cttatgtgcaacgttacatttcggttatcatcttagttcccaacaacataactcatgcatcaggatgccattccatgtcttaggacaagtcaaccatcttgacttgcttgaacatgtctatcaagatcaatctatgtgtcactcatctcattgtgacatcctaaacatccattcatcatgtcattcatacctatcagggtcatccaacactatttttgatagacccatttcaaagaaagttgtccgagacactcgtccacaccgcgacacacatatgtgccacaagatagcccgcttaggctacatggcccaggaggagaagagagctaacaccatgcctctcctataatacattttgagccatttctaatctttctggagtagacgttattttgacaagtagtcatattgtagcattgagcgttgtcggatatccaattgacacaaattttggtgagtttcatcttttatataaatgaacttaactctagagccgtatcccgaaaactcatatagaaattctgacttctaaggttatgacccagggatctactcgaccctcttcgagattgtcttcgacgctcgtggttctctccaaccttcctaatttttcaatttgactttaatgtatacccttggtatattagatgatgcatcgtcctcttttcgtatcataacgcgtattggcccgggaaacataatttaaaagtctccccaagcctatctttgagtgtggggtcacagcccatctagagaaagaagaatagtagattcaactcaaagacgcgcaaaacgtctagaattttcttgagaaccactagaacctaactccgttataacgacgttagttgttgttttgcgtgctattattgagtcggcttattgctttgaattttggtccacagattccatttctgccttcgcctgcaagtaacggcgattgacagataataaatgcttacgtggcggaaatgtgtggataattcatcgcctgccatgacctaattctccttacaatttcctataaattcaccccttccgccctgggtttctccgcaattgaatctctcttctttcatcgaccaatctacagcgaattcttccaaggtatttttctgctttcttttctttttcgctttgattctgttcatctgtttcgagagttctggatcggtgttgtttttttccccttttgttgtggaaatttttgaatcgtttattcttctcggagatctgatgctttgtggttggatccgcttggatcgtttgaagttttatgatatgtattcggattgtagtgtgttttgtgagagattggcttgaaacattgggattttactgattttatcgaagtgaaatttagaatttaggtttttgacttgttcgtgttatcgttttgatagaaattgtcctgatttttgtgtttccttctgtatag

SEQ ID NO: 33 - DNA, 2560 bp, Helianthus annuus
tacacttaggctattacttaacgcgggtcgcgagaggcctgtttttcagatttttaaaatcttttgaaatgattacgaaatcctggtaattaataacgaaatctttcgtaatgatttacctgacctttcgagtttgaaggggtaactttgcggtttggccctcggttaattacaactaaggacctcgtgttatttacccgcgttgttaagtccccgattagtttattaattactcagaaagccttcactttcattattgacgcttttaacccttctcctacgaattcgatcgtaactttctcgtttcataacgaaacttcgcgaaatttatatattatattttagtgagtgtataataccgttacaaagccttgggaacgttaaagggtcactcagaggtataattaaacatgttgacacggttaacccctgtagcttgtaatctctcactttctttcgtgtttcgcttctgtacgatctatgatttatttgtttgaaggttcaagcattatttagggttagtatacagtatatttacccttgttgacatttataaccctcgaatttatatactttcaaggtttgtcaaaattagtcctttatttaatattaatgccacgtgtaaacaaatgacacgtgttaacacatcattggacgcaaaaattcgaggtgttacagtaacagatctgaacccttgcttgatgctaagttgttttcttgtaggttttattatttcaattatcgctttattgcttcgttctaaacctgatatgtaagctatgagattattcttgtttgtcatatacttacatccgtttgttattgtgatttattaactgcgtttaagatatgcgcataaaaagttcagtcaacaattaaaaccatactacagccgcctgcattattacttttaagatatgtgtgttattgcttttgcgaccgaaaattattatcctgttggtttaatcgggtcagagatagtcatatcggtcgggatcgataaacgggtcggcatcaacttgggtcgatcggatccgggtgtgcatgtttgtggttgtagatgttgcaggtggaaagagagagaagtgtgttgaggtggggtatggcaggattatttatatatttatgaaatgactaaaatgcccttgacagacttaacacatatggatgaagttaagtcagttggaccaaaatggcaacgatgaaatatttttagatccagatgttaaaaataaaacctttgaactaaactgttaaaatgacccaaaccatagggactaaaatgacatttaactcttaaaaaaaaattagaaacaagataagggtcacgcaatattttattccaaaataaaaagaagacgccaaacctaaaaatcagcgactccattaaaaatcaaaacccatcaacggctcttatcttaactttggtgtttggtcaccaatactttatacacgtggcacattctccaccgattgttatctaaccgcaccgtcacgttaacctttctttgcgtgcacccttagctttattgttctataaattcacccccaatttatccccttcattcatcaaccaattctcttatcttcttcaatttctcagatctcttcaatcccttcaaggtatgttcctttcgatttgtgtgttttgtttttgttaatagatctgctatgtattgtttgatctgttaagttttagatcgatttgtttagatttagatacgctatatcgtttgatcggttaggattttgatcgatttatttaggtctgttatatcgtgtgatctgtaagctttttgattgatttagacctaaaatttgatcgtaggtgacttttactatgtatatattacgtctgattgttaggttttcttttagatctgtgatattgtttgatctgtaagtttttagattgatctagattgaaatttttaacggtaggtggtttaatatgcacaatttaacgtctgattgctagattttcgttatagatctgttatattgtctgatctgttaggttttcgatcggtaggtggctaaatatgtttgtatctgattagatctgatgattagacaaaggatgatgtgttttgatcttgaattcctttcgatttcgcgttatttataggtttttgtttcagatcggtgatatatacagttttacgtctgatcattagtttattgttttggatctgttagtttattgatcgattaaaacctacagttgatagtaggtgtcttaatatgtttataattcttagtctgaaccgatttgataagtacacaacgattttgaacggttaatcgtctagttcttgcagttttgtggataatgattctgttttttgtatgatatttgatctgatgattacataacgttttgtggttttatattatgaatttttaacagagattcgttaagatttttcagtcctgtttgttatgattttgtttttggttgaaattctgttttattgaggcgtgtttacttgtatttaaaaagttattttggtattgttactgatcttctgttcttatgcttttcaacagtagcaaaacc

SEQ ID NO: 34 - DNA, 601 bp, Solanum lycopersicum
tcgacatactcgactcagaaggtattgaggaatgatcgattctgggtcatttgtgtggttaatcaccctccaaatcaactaagtcatcctgaaggacaatatcctattttttctctcgtaggtttatcatttaaattactatcgcgtgataattttgtaacgtagaaaaataataccattaatccaaacgttatattcattaaaataattatgatacatttaaaaatatttcgtgacctctcaattattgcaaattctaagccatcccaagttttgaggctaattttttttactatactatttttacaaccacaaaaacataaaaaataaaaaataaaaaaaataaaccgagtcaattgctacaatcacttcattattaattttaattaatattatgtggttatatatgaaactgttagagaaataatagctccaccatatttttttctcaatttattttcactataaaaaggctatttcattataatcaaaacaagacacacacaaagagaaggagcaataaaataaaagtaaacaacaatttgtgtgtttaaaaaaaaaaaaaaagtacacacaccaaaaaaaaaaattccaatttaaa

SEQ ID NO: 35 - DNA, 2054 bp, Helianthus annuus
taatcaacatcccgctgcaacgcgcgggtaagcataaactcgttcctatacaaattacaattccaaatcattcgatgaatcaaatgccacctaagaagatattaatctcataatcaaattattataccaaatcattgatctgggctttgtattactcgaattaatgctgttatgtttttattaaacgtatgggcttgcttgaaccaggcttaaggcatgagtgtacttttttttaaacaactaacataatcaatttcaagcacttttgggacaccgactggattaaacgcagtactttgaaagtaacccaagtccacctactcgtagacacaacagtaaaattactggtaaaacctgttggtttccctgagttttctgtcattgtccactaatgcctcattcttcaccaaatagaagttgaacctgcataatacaataaggctatgggatatactttcacgccccttaactacacgtaggcatcacatcacgtacttgaccctctttcacttcacttcacaacaaggaaattgtttaacgcccattaacaccccttaaattaaataaaatacatatatatagcatgttgtgtgtgtgtaaattttgcgatgcttgattctctccctctctctcctaattaacttcttaacatataaagcttttaataactcttaacactcttcaggaacggtataataaatgttaacggataccaactaggattacgtgatacaagccttcctctctaaaacttaagaaagtcaccaaaaagaaagtcaaagacggcaacggcaacccagaagctacgttctctttctagattctatgccctacctaccgtgtggtgcacaacaacttgacccccatcattgactctccaccgtacacgtgtcacgataccatttgttggtctcctaccacttacgtaacattaatattccatccgtgaccgcctcttcttcatcatcctataaattcaccttcttatctcttccgctttcattcgttcatcatcatcacaattaacaacaatccaaagcaatcttctctcatattcttatctcttcctgtttcgcttcgtctctttcaaggtatctatcatccttttctctatatatctcttcttgattattatgtgttgtcagatgttagatctatttagatttggaattgtgtgattgattatatgatttagaattttagatgcatgattgatcttcgtaatcatatgagtaatcgttttcagcgagacggattgtagatctggacgattgtaggtttttacgagttgttattggatcgtttgatgattgttgttatttgttagtttgatctgtttagatgtaaaattgtgtgaacataataacggagagatgacttgttgataatcgttctcaacgagacagattcatgttttactctagatctggctaatgtgaatttgtgtgtttaattatgttttgtatgtattatatagtgaacctatgaagatatggtttgatgcatgattattgatatgaataatcctacgagtaatcgttttttacaagacgacttgtctctcactgtagatcatatatgagttgttcttggatcattcgatgactgttgttgattgattcggtttttctgtgatgatatggtggaacttaataatgaaaagatgttttagatgcattattgatttgataatcttgaggagtaatcgattttaacaagacatatacgaattaacgaattattgcctttttatttgttagtttgatatgatttaggtataattcgtcctgtttgattcctttttctgtaatgatatgatgaacttaataacgtagagatgttttcgatgaattttaattttaatatttgttagtgtgattttgggtagaattcgttgtgatttgggtgtttgacttagtcactagttcatgtttgatgatcttacttagtacttcataatttgctttgtttctcattccagcccatctgatttaagttattgatggtataatttattgcttagggtattaatctgtttgtattttttaatccag

SEQ ID NO: 36 - DNA, 983 bp, Petroselinum crispum
gaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcag

SEQ ID NO: 37 - DNA, 585 bp, Solanum lycopersicum
tgtcttttaatggataattactaattttagcggtactttttatttattatcatttataataatactatgttaaatatgcaacatgtattagaagtgaattaagtatgcaatagatatgtatttaaaaatatattatgcttgtttgataagaagttgatgcattgtattataagtacgttagaatgtgcaataaatatattatctatcattagaacttgaattataagtgaataatagattattttttgtaatatgaattaaaagtgtattaaacatgtattaacggtgatcaattggttaaaaaaaagtttattattaaaatgataaatctttttaatttatagtatatttatgtaagttttcacgttgagtaaatagcgaagaagttgggcccaaccaagtaaaataagaaggccgggccattacaattaagtcgtcacacaactgggcttcattgaaaaaagcgcaaaaccgattccaggcccgtgttagcatgaagactcaactcaaccagagatttctccctcatcgcttacagaaaaaagctatatgctgtttatattgcgaaatctaacagtgtagttt

SEQ ID NO: 38 - DNA, 352 bp, Medicago truncatula
atgcctatcttatatgatcaatgaggcatttaattgggtgcatatgatggtgaaaaaaggtgcagctcctggcttgggaatgatgactcatgtggaatttggtcttaaatttatcacatccttttgggatgtgatgattgtatcacttgttcattttgcaaagacaaggtgcactgctacaaactttggtttaatctgaaataaaacaaaactcactgagaggaagatgcatcccagtaggtgaaagtcgagaaggatttgcatgttactattacacttgctttttagtcccacatcgtctgaaacataaaatatttcagcgtttaaatacttcaagcgaaccagtaggctt

SEQ ID NO: 39 - DNA, 472 bp, Glycine max
cccgggttaagagaattgtaagtgtgcttttatatatttaaaattaatatattttgaaatgttaaaatataaaagaaaattcaatgtaaattaaaaataaataaatgtttaataaagataaattttaaaacataaaagaaaatgtctaacaagaggattaagatcctgtgctcttaaatttttaggtgttgaaatcttagccatacaaaatatattttattaaaaccaagcatgaaaaaagtcactaaagagctatataactcatgcagctagaaatgaagtgaagggaatccagtttgttctcagtcgaaagagtgtctatctttgttcttttctgcaaccgagttaagcaaaatgggaatgcgaggtatcttcctttcgttaggggagcaccagatgcatagttagtcccacattgatgaatataacaagagcttcacagaatatatagcccaggccacagtaaaagctt

SEQ ID NO: 40 - DNA, 445 bp, Arabidopsis thaliana
cttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgatt

SEQ ID NO: 41 - DNA, 306 bp, Glycine max
aaaataaatggtaaaatgtcaaatcaaaactaggctgcagtatgcagagcagagtcatgatgatactacttactacaccgattcttgtgtgcagaaaaatatgttaaaataattgaatctttctctagccaaatttgacaacaatgtacaccgttcatattgagagacgatgcttcttgtttgctttcggtggaagctgcatatactcaacattactccttcagcgagttttccaactgagtcccacattgcccagacctaacacggtattcttgtttataatgaaatgtgccaccacatggattg

SEQ ID NO: 42 - DNA, 445 bp, Arabidopsis thaliana; identical to SEQ ID NO: 40

SEQ ID NO: 43 - DNA, 323 bp, Arabidopsis thaliana
ccatggatgttgttgttaccagaaagtaaataaatgttcaatctctgatgttctcaagtaagtgagttttattgggaataatattaacttatgttcttcttgcatttgatttctttgccgctctcttcttctatcttaaatctgtgtatactatttcactattgggctttttattagtctataatgggactcaaaataaggctttggcccacatcaaaaagataagtcacaaatcaaaactaaattcagagtcttttctcccacatcggtcactgtactcattttgtgtttgtttatatattacacgaaccgatctttggtac

SEQ ID NO: 44 - DNA, 1982 bp, Zea mays
caattaatgcacgtcggcccagtaactcccgtcggccagacagggccgacatgcattaatttgtaatccccgtcggccagcggtagccgacgggagttactcggccgatgtgcattaattggtaatccccgtcggccagccgtagccgacaggaattactaattcccgtcagtgcccgacgagaataagcatatccccaacatctgatgcccgtcggcttagggtcgacgggaattaaccatataccgacgagaattagtaatccctatcggtttagtgcttattcccgtcggttctgagtcggcgggaattaattggattcttgtagtgatgcactgagtttttactataattttaacaagtaaaatgactaacttggataaaaaaatgtttcgtggggcgggtacatggggaacgtggacggtcctcgtgaactacggggattaaattttctccatttaaatccccgcggggactaaattagtctcatacccatcccctaataggggaattttccgcggggaattggggatcgagtccccattgtcatctctactctgcgcacgtctggatggtcgcgcctggggcccgaacggttcacgatggcgcagagggtcttatttttcacagcagacctagatcttgcctctcgggagggatcccgtcggggaggagagatcctagggtgtgtcttggtgtcagcaggccacccaagacgcttctaatcgatgtagaaccgaagaaatgcgaagatttaaggtagaggaaggctaaactagagctactcctaatacaaaatgtaaaaacgataagtaaatttgatctgatcgaatgtgggggttcaatcggccgtagccctttatatatataaatgagagatctgaacccgttacatgtcgtttaccgagttaatctcgtagatttagctaacaaatcccacaagaaaatcgaaatcctaaccgattctacacacaagcggaccatccatgccatcaccgcggatcatccggcctagcgtcccctgcccaaaagtgggctcaacaagcctaaatacatataatttataccacgtgcaacacatttattcatccatatcacatgtcatgcaaggcataagcatcatgttaacttagttatactgacatacatttatgagttgagatgtccaggatgtgagcgcatgagcccattgtccattcaggaccaagacaggctactaagcactttctacataacttgtatgtgctaactatagcatgcttatatggctctctccaaagttcaaagctagctcaaatcttttgatttaataaaacttaaatttgtttgatttcagataaactgataatttttataatatttagagtgagttgaaaacagaaactggccgcaaatccacctcaagccttttgatttgacctaaaaaaaagaagcccccacaaacaccactccacactagtgcactgtctctctccaaaggcagctgcattggcctccagccttttccctactgtgccgcgcgccctcccttctctctaatgatagcatagggagagaaggcatactccgaggcatccttctcctttccctctccttccccaaacccttttcctctttccctcgccccaagaacttcatctcatctccaggcgccccttttgcgcttgcgcaggagtagctcacggggacagtgggcggatagctcgatcgctgcaccactacttcactggaggtccgcccactccctaggcaagcaagactagtagccgcagtctaacaatagctctcctgcttccggttcagctactgctgctagcgaagtttggccacatctgatgtcaagagcatggcgcatgcacatactttctgcttgcttttacatagcatactatagtttatgcatgctgctcatgtagacatgtgcatctggtgttcggaactttctcaaacggccgtgggtgtttgcaggtgggggcaaaacc

SEQ ID NO: 45 - DNA, 2051 bp, Oryza sativa
tgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgaccagctcctcccccctccccctccgccgccgccgcgccggtaaccaccccgcccctctcctctttctttctccgttttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaa

SEQ ID NO: 46 - DNA, 842 bp, Oryza sativa
tcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcagggggtccgggtcgtgggggccggaaacgcgaggaggatcgcgagccagcgacgaggccggccctccctccgcttccaaagaaacgccccccatcgccactatatacatacccccccctctcctcccatccccccaaccct

SEQ ID NO: 47 - DNA, 1973 bp, Panicum virgatum
cacgtcagtgtttggtttccactagcacgagtagcgcaatcagaaaattttcaatgcatgaagtactaaacgaagtttatttagaaatttttttaagaaatgagtgtaattttttgcgacgaatttaatgacaataattaatcgatgattgcctacagtaatgctacagtaaccaacctctaatcatgcgtcgaatgcgtcattagattcgtctcgcaaaatagcacaagaattatgaaattaattttacaaactatttttatttaatactaataattaactgtcaaagtttgtgctactcgcaagagtagcgcgaaccaaacacggcctggaggagcacggtaacggcgtcgacaaactaacggccaccacccgccaacgcaaaggagacggatgagagttgacttcttgacggttctccacccctctgtctctctgtcactgggccctgggtccccctctcgaaagttcctctggccgaaattgcgcggcggagacgaggcgggcggaaccgtcacggcagaggattccttccccaccctgcctggcccggccatatataaacagccaccgcccctccccgttccccatcgcgtctcgtctcgtgttgttcccagaacacaaccaaaatccaaatcctcctcctcctcccgagcctcgtcgatccctcacccgcttcaaggtacggcgatcctcctctcccttctcccctcgatcgattatgcgtgttccgtttccgtttccgatcgagcgaatcgatggttaggacccatgggggacccatggggtgtcgtgtggtggtctggtttgatccgcgatatttctccgttcgtagtgtagatctgatcgaatccctggtgaaatcgttgatcgtgctattcgtgtgagggttcttaggtttggagttgtggaggtagttctgatcggtttgtaggtgagattttccccatgattttgcttggctcgtttgtcttggttagattagatctgcccgcattttgttcgatatttctgatgcagatatgatgaataatttcgtccttgtatcccgcgtccgtatgtgtattaagtttgcaggtcctagttaggtttttcctactgatttgtcttatccattctgtttagcttgcaaggtttggtaatggtccggcatgtttgtctctatagattagagtagaataagattatctcaacaagctgttggcttatcaattttggatctgcatgtgtttcgcatctatatctttgcaattaagatggtagatggacatatgctcctgttgagttgatgttgtaccttttacctgaggtctgaggaacatgcatcctcctgctactttgtgcttatacagatcatcaagattatgcagctaatattcgatcagtttctagtatctacatggtaaacttgcatgcacttgctacttatttttgatatacttggatgataacatatgctgctggttgattcctacctacatgatgaacattttacaggccattagtgtctgtctgtatgtgttgttcctgtttgcttcagtctatttctgtttcattcctagtttattggttctctgctagatacttaccctgctgggcttagttatcatcttatctcgaatgcattttcatgtttatagatgaatatacactcagataggtgtagatgtatgctactgtttctctacgttgctgtaggttttacctgtggcaactgcatactcctgttgcttcgctagatatgtatgtgcttatatagattaagatatgtgtgatggttctttagtatatctgatgatcatgtatgctcttttaacttcttgctacacttggtaacatgctgtgatgctgtttgttgattctgtagcactaccaatgatgaccttatctctctttgtatatgatgtttctgtttgtttgaggcttgtgttactgctagttacttaccctgttgcctggctaatcttctgcag

SEQ ID NO: 48 - DNA, 2119 bp, Oryza sativa
ccgtcaacaaaagaaatcaaaagggaaatgcaccatcttatatctccagtttatatgaacagattggataagatcataagatcaagtggtttatattattttgaggaatataacatggattcatcctaatcactcgtctaggcagtatgtgtattcatgatggatatggtactatactacggagttttttcttcacaaaataacctgttattttgacctccaaccaaacacgaattataccaaaaattgggttatttcatctatagtacaactctattataaacatgcagtaaattatcctacacatataccaaaattcaagtgtaataatcctaatacacagacttaaaaaacaaactatttcctttttaagaaaaggaaaaccatttttttaacggaaggaaaacaaattcgggtcaaggcggaagccagcgcgccaccccacgtcagcaaatacggaggcgcggggttgacggcgtcacccggtcctaacggcgaccaacaaaccagccagaagaaattacagtaaaaaaaaagtaaattgcactttgatccaccttttattacctaagtctcaatttggatcacccttaaacctatcttttcaatttgggccgggttgtggtttggactaccatgaacaacttttcgtcatgtctaacttccctttcagcaaacatatgaaccatatatagaggagatcggccgtatactagagctgatgtgtttaaggtcgttgattgcacgagaaaaaaaaatccaaatcgcaacaatagcaaatttatctggttcaaagtgaaaagatatgtttaaaggtagtccaaagtaaaacttatagataataaaatgtggtccaaagcgtaattcactcaaaaaaaatcaacgagacgtgtaccaaacggagacaaacggcatcttctcgaaatttcccaaccgctcgctcgcccgcctcgtcttcccggaaaccgcggtggtttcagcgtggcggattctccaagcagacggagacgtcacggcacgggactcctcccaccacccaaccgccataaataccagccccctcatctcctctcctcgcatcagctccacccccgaaaaatttctccccaatctcgcgaggctctcgtcgtcgaatcgaatcctctcgcgtcctcaaggtacgctgcttctcctctcctcgcttcgtttcgattcgatttcggacgggtgaggttgttttgttgctagatccgattggtggttagggttgtcgatgtgattatcgtgagatgtttaggggttgtagatctgatggttgtgatttgggcacggttggttcgataggtggaatcgtggttaggttttgggattggatgttggttctgatgattggggggaatttttacggttagatgaattgttggatgattcgattggggaaatcggtgtagatctgttggggaattgtggaactagtcatgcctgagtgattggtgcgatttgtagcgtgttccatcttgtaggccttgttgcgagcatgttcagatctactgttccgctcttgattgagttattggtgccatgggttggtgcaaacacaggctttaatatgttatatctgttttgtgtttgatgtagatctgtagggtagttcttcttagacatggttcaattatgtagcttgtgcgtttcgatttgatttcatatgttcacagattagataatgatgaactcttttaattaattgtcaatggtaaataggaagtcttgtcgctatatctgtcataatgatctcatgttactatctgccagtaatttatgctaagaactatattagaatatcatgttacaatctgtagtaatatcatgttacaatctgtagttcatctatataatctattgtggtaatttctttttactatctgtgtgaagattattgccactagttcattctacttatttctgaagttcaggatacgtgtgctgttactacctatctgaatacatgtgtgatgtgcctgttactatctttttgaatacatgtatgttctgttggaatatgtttgctgtttgatccgttgttgtgtccttaatcttgtgctagttcttaccctatctgtttggtgattatttcttgcag

SEQ ID NO: 49 - DNA, 1830 bp, Oryza sativa
gttatcacgtcggcacgccgacgtcgctgcgcctgcgcgtgggaggccagggcagatgctacgtgccatcaggaatgtcgacctgatgattattttgttgatcatgattttcttttggctatttgattttttgaaagatatttttttccctgggaagacacctatgggacgaagatattatgtttcttatatagcaccaaacaaatttaatatatatatatatatatatatatatatatatatatatatatatatatatatatatatatatatatatatatatatatatatatcacatcagtctctgcacaaagtgcatcctgggctgcttcaattataaagccccattcaccacatttgctagatagtcgaaaagcaccatcaatattgagcttcaggtatttttggttgtgttgtggttggattgattctaatatataccaaatcaatataattcactaccaaaatataccatagccatcacaactttattaattttggtagcttaagatggtatatataataaccaattaacaactgattctaattttactacggcccagtatgtaccaatacaaaacaacgagtatgttttcttccatcgtaatcgtacacagtacaaaaaaacctggccagcctttcttgggctggggctctctttcgaaaggtcacaaaacgtacacggcagtaacgccgcttcgctgcgtgttaacggccaccaaccccgccgtgagcaaacggcatcagctttccacctcctcgatatctccgcggcgccgtctggacccgccccctttccgttcctttctttccttctcgcgtttgcgtggtggggacggactccccaaaccgcctctccctctctcctttctttatttgtctatattctcactgggccccacccaccgcacccctgggcccactcacgagtccccccctccccacctataaataccccaccccctcctcgcctcttcctccgtcaatcgaaccccaaaatcgcagagaaaaaaaaatctcccctcgaagcgaagcgtcgaatcgccttctcaaggtatgcgattttctgatcctctccgttcctcgcgtttgatttgatttcccggcctgttcgtgattgtgagatgttgtggttagtctccgttttgcgatctgtggtagatttgaacaggtttagatggggttcgcgtggtatgctggatctgtgattatgagcgatgctgttcgtggtccaagtattgattggttcggatctagaagtagaactgtgctagggttgtgatttgttccgatctgttcaattagtaggatttagtctctgtttttctcgttgatccaagtagcagcttcaggtatattttgcttaggttgtttttgattcagtccctctagttgcatagattctactctgttcatgtttaatctaagggctgcgtcttgttgattagtgattacatagcatagctttcaggatattttacttgcttatgcctatcttatcaactgttgcacctgtaaattctagcctatgttaattaacctgccttatgtgctctcgggatagtgctagtagttattgaatcagtttgccgatggaattctagtagttcatagacctgcagattatttttgtgaactcgagcacggtgcgtctctctattttgttaggtcactgttggtgttgataggtacactgatgttattgtggtttaggtcgtgtatctaacatattggaataatttgattgactgatttctgctgtacttgcttggtattgttataatttcatgttcatagttgctgaccatgcttcggtaattgtgtgtgcag

SEQ ID NO: 50 - DNA, 2212 bp, Aegilops tauschii
tgcagcgtcccggtgccgtcggagcttgccgcgactactgtggagatccgagggagcttcaatggagtgtgtcaagggctgcaatggagcgccgccggggtcgttggagcttgtcgtggattcaagctttcaccggagctgcaatggagcgccgtcggagcttgaagcttttttcgcgccgcagtgcaacaccgccgtctatgtgcaactttccgcctgtttcaatgaagcaccgttgttcgtgacacctggtgcaacgcggcattgccgtcggacgcacgagctgagagggggtgccatggcgctaccaaccagggatgttgcttttctctcccaacgcaaccacaatctgctcagctccccacatgcagcaagctcacatgccgcacctagcacaccgcgacacgaccacgtgactgctactatcgggggccatggccagcgagctcaagggttggggcagccatatgccctgcaaagctcaagggttgtggcggtcatggcatgtgagctctggggcgagtcgttataggcggcgctacaaccgcggaagctgactgctacaaccgtggtgaccgtgtgtcgtgacccccagtggggctatgctgcgaccgtccgggtgagaagctacgcccccagccgaagatgttccgactgacatgggcgggggaggggagcacgggcgggcggcgcagcaatcgtcggcgacaggaaggtgcaaacctcgacagccatgctacaaccttccaatatctggagctggagacaagaaggttaccggtgtggtgctcagatcggccggccgatgcagagcactgtccaaggcgaatacaaattcgagtcaaaattgtgacaacacagtaggcgtggccgtacgagttcgagtcacgcatgactaacgatgctcacgcaccgcaccaacggcgtgagcgcggcgtccaactccaacggccaccaaccagccaaatccccaacagcaccaaacgacgtcacctttggaatctcctcccctattctggcttttgcgaccgcctctctctcctccgcctgcctatccgctccatcctccacacgtcaggcgtgccgtgtctcttcttccttctctccctccctcccgtccgagcctgctataaaatccctgccccctcccgtctcctctccacacatccgatccaatccaatccagtccccgtccaatcgaagcgaagcgaagcgaaggctctctcgtcctcctcctcaaggtatgcgatgcgagcctccgattttctctccgccttctcgtcatgtgcgtgcgtgccccgggatcattgataagactgccctgatcgattattggtggttcccctcgattcctgttagtaggttggagtagatctgcgggcgggccgagtctgttatagtcgactgattgctgctggttcgctcagtcgaggttgattaagtctcgattttagattaatctctctcgattatgcctggattttcgagtagatctgccgattgggatgcgatttttcttggtttcgtccatctatatatatgctgtggttagctatgtctgctggttgttgataaatcgtcgcagtattcttggatttacgattttgtacccctcgtatcacaccagcaatttgctgttgctaacctttgcttgctgtacgctgtgcatcgactttttaccttcatattgctcccacaaggctaaagattgcttgtagatctgctaatatatttctgttgagttctgctaagatttagcactgcatgctctgaaatccgtttgcttagtctagcggattctttgtactgtggcctcgtttatctatagattgacttactgcagatttcattattcttgtggtttcggccctgtagctacttgtttagtcttttgattcaactcttaaatacatgtgggtttgatgatgttactgttaatacgtccatgacttgaccagcttattctgtttaactgactaataatatatactccccatgaccatgaggctagagatttcactgataataaatctgctaatatatttgtggtaggggttcttccaaaagttagcatcgtcaatcatttgattagcttattctaagggattccttagttacaattccatctctgttgtataatccggttcatgtattgttacagatttctctgtaccgtttctaactctggttctgtgtgctttgttgtttacag

SEQ ID NO: 51 - DNA, 2452 bp, Unknown
  Panicum hallii
aatcgttggtcaactttccttccattactttttaatacgtaacaattatccctaaagcctaattaagtaattcaacttccgaattcaataggggatcatctgggcacgacctaattgaaaggataacaatagctttcaaacaacatttccacttgtggtaagatttaaggtcttaacattgtatagttgtttttctcacggccctagacttgagaaagggaccttttgatatcgttattgtgctccataatttttagttgggacaaatgtaatttcttatatttacgataaactcgattctaatgtattgataactccaatgccgtgtccatttatggtgttatcatttgtttcctgatttaaagaaaaaatataacacacaaaaaagatgattttggaagtttacaatcacgttcaccattactctctaccatatcttggcgttgttgccaagcgtatctagtaatttcattcttgaaagcctctagctcttaaacgtaatttatgatacagtactatattttttttattaagggcaaaagatcgagaggtaaatggtctgctccgtaaatttatcttacatagaggctttaaaaagaaatatcatgtaaaatcgcttttgttagaagcaggtcatgcataaccttccagggacatgccagttgttagttgcttttttttagtttctctttcttttacctgattataatcttttaaagttatagtcttgtatttctaatatagaaacgcatacgtgtgcgccgttgttaaaaacaaagagatcatgcatgattgaagcatcaccataacgacgttaatcttccgtccagccattaacggccaccaaccgcaggaggcaaacggcgtcaccatcctcgatatctccgcggcggccgctggcgttttccggagaaattgcgcggtggggacggattccacgagagcctctcgctgctgggccccacatcaatggcgtaacctcacgggacgcttcctccctcctgcggccctcccccgcgtataaatagcacccctccctcacctcttcctcatccagtccccaacccgtcgagaaattctcccgagcgattgcaatcgaagcgaagaggtctcccccgatcctctcaaggtatgcgagtcctcgatccccttccgatctatctcgtttctcgcgtgctctccctgctcgtgttcgtcgtcgatctagtttagggtttgatttggttctgaatcgttcccttttcctgcttgcgttcgatttgtcgtcgattctcgggtagatgtgtggatctgcggggcgtgatgaggtagtttggtgtagattcgtgttgggcgttcaatttgcctctagggttcggctgctgttggcatgcctgtgatcgagcggccggataggattagttttttttatatatatatgttggatgcctgatttcctgtatgttgggttagattgctggtacgattcatctaggcggtgctttgcagaggaacagccttgctgtttagtatttggtagctctttctacattgattacttttgatcatagcctgataatgatcaccgattggtgtggaattaattatttcattgtcgaaagcatagctgatgtagatatagctgcacaatttcttccttggctccttactgtctaaattgtagagtatactgagttactgcttctttatcagtttctctggattgttgtatccagttaggccagtgttgtcaaaatttgacatggtagttcatctgaaatttctccggactgttggtatgctcgtggccagacttaattgattaggctgttcttcatgttggatcaccccatggtttgtgatacctgttgggttagattgttggttcgattgctgtttaatcttggtagcttcatctagatttgtacaacttttggtcacctgatgatgatcaccgattgttgtagaattagttaattcattgttgatctaggtgtggaattaattagttaattgttaatctatggcatggctcatgcagatattgatgcaaattttcttaactggttccttgcttcagtgtgtatctgtttgtctgtgttttaggccacatcatatgattgtcaaaattttaaatggtagtttaatgataaatgtagttcagcttacttcagtgttgatttgcttcaaatgtagttttctgtcctattgaacatagaatcttcatgagatgttaatgtattctcttgttcagaattgatctgtttcaatatcacaatattatgtgtcctgtaaagttttttagtatgatttgttttaaatttagttagcctatcctgttaatataggatgatgagccgtgagatgttcattctcttttgttcagagctaatcattttcaatgttgcaatgttctgtgtctagctggatgcttacggtggtttaactctcttctgttccttaatgtttgcag

SEQ ID NO: 52 - DNA, 1783 bp, Zea mays
gtagattacgttggttaaatatatatgaatgtgaaacaacaactaaaatttgaactattaattatgtataattttatcttatttttatataaaacagagaggagaggagcgatgactgtggcgtgtgggaacgtggaaactcgctggcccatctcgaataattttgctgcacttctaataccttcacgagtctgcacaagcatagattggtgctggttgaacggccctgattcttttttttcatggctctgcgttcgagagcatgtttttcgttgaaggcttctttggttagaagtgacctgagtgaattggagaggattagaggcatgtttggttcactacctcagttgctacattttgcctaacttttctgcctaaggttagttattcaatttgaacgactaaccttagacaaagtggggcacatttagccacaaaccaaacaggccctaaatctatttatatttaattttaaatatgaataaatttaattctattaatctttgtcgagtgttctttgccgagtgttacactcggcaaagcctttgccgagtgtaaaatagcatttgccgagtgtgttagacactcgacaaagaacgcgattccggtagtgttaatttcctctagtttttatacaacaaagcataagaggatatatttcttttcttttactttgatgaaacaatttggttcttttggacgagccaaaacccggatatggtccaattaagaccttattcgtttgtccaaaaatgtaacaggaatcatttcagatgatcaaaacttatataaattagagaaacaaatcggctaggaattatttcatatctccattcctgaagaaacgaacggtcctaaggctccaagcacgggtctatacatcaggttgcgccggtctaagcccgcacaacattgggtcgggtcgtgttcaagcattaatcgtggtatagactggaccatcgtgtcacgggctatataatacatttgagaatgtagaattaaatacatactccccgactctaaatgacatattcatatacgaggatggtacttctttggactatatagggacggaggtcgggagggaattcgcgagagcaagaaagcagctacggtagccatgcatgaccatatgaaagcgacgacgcgagaggatgtatggtttgggctgcttaaatacaatctgcaatagactgtgctgcattgcacattattcttatgaaagagtgtgtttcatctctatttatgttgttttggataaaatgttttgtttatttatgaaggacatatttccttatcaataattcctacgcccaaattaaagaagccctggaatcaggaactaggaaggggcaccgatgtgattttgtgagccaacgacatggggagcatgagcgtgagcaatgcatgtttgccgagtcaaacgttgccccaccaacaagcaagtgcgtcgtgcgtggatcctctccttcctctctcttggttcctgttatctctctcggctgtccactcccccgtgatgtgagcgcgtttctctcccgtcctctcctctcctcccccgcaacaaactcctgcaagctgctctcgatctctctctccgtcgccatctctctcgcgcgcgcattacttgcacgtacgtgctcagaaggaaggcagaggcaaaagcagcctaggtgatatgatacctcctcctcctcctcccattagctcctccgcatgcatcatgcatgggtacgtgcgcgtgctacattttatttgaaatgaaatggctggttgtctgcag

SEQ ID NO: 53 - DNA, 3710 bp, Zea mays
gcccgacaagaaagctaatgggctgggctgccaaccatgtttactaggctaggctcattcggatgctagccaatcgttcctgcactgaggctctagatttcatagatagctaatgggctgggctgccaaccatgtttactaggccataaaatgaacttttggtttgtttaataatattatgccgggttttagaaacccatgggtttgcgggtatgggtactaggatcccatactcgtaccctcatacccgctgggtttagcttatcacccattaagaaacccgtgggtttggatattagcccgtacccgtcccctaatagggtaaaaacccaccgggtttcgggtttcgggtacccattgccatctctacctgtcaatgacccatttaaatagagcccatcgaagcccactaaatatttaacatttttgagctagttgtactttttccttttttaacccaaatttttaatgtggcacccacaaacaacccaattttattttggttatatatgttatgtacttttatttatgttatttcatgtgatttgtgctaacctgacacattaattttgggttaattaagttggataggcacacttaagtattcatgggttgtgttttggatcgacggcttgacgtcttggtccacgggctggcacaccacgacccgtaattgaaattgtactttagtggactgtgccttagtggattgtgctttaataagcctggggtgtaccatattgggctgatccagatatacatgtacaccggggagtatttatctttgacacaaggagtatttacttattatgaaaccagctccaaaaagtggcttctgagcctatccacgtcgtccattaatctttcgaccgtaggatcggattccaacggctacacgagtgttctcacgcaccaggcgccaggcggcctcctcatgctggataaatcgtgacgcttccagatgatacatctccctcttggctgccgggcggcactctccatggtgaagagggtgtcgaccgcgatggctacaacgacgacgatggagcacttgacgcccccaacagatgcgagccattctcctcctccctacgtcctttccccctccacgacaccataaccgtgcctgctccgccgaatctaaaggtgtcaggatccccaatccttcccctcctctccccctctccacgacgctgcaactgtgctcgcatcgccatcccctcccctcccctgtctccaagccaggaatcccatccccaccccaatgtcgcagttctgctcgcgttggccggatctgtgaatgaagaacccacggttccacgacctcctcttcgtggaagcctaaaaggcatcacccccataagcgagagggaaaagacacattcctatatattctcttagtttgtccgctgttgtctagaaacatcatgtaatgaggctgggaaacgatcccacggagtgctcccgtgtccgtcgcctcggttcggcagaggccagcaaccgcggcacctggtccacagcagcagccaccacgactcgctagggctaggccgacctagatgatatgcagtgagctgatgggagggatgggcgagcaagaattggtacagtaaccggaagacgatcttgatttattccttatgtcatgaattcctttttatttacacccacactttctaactttcgtacaatgattcgtatatttaaaacaaggctaacttatgttctcatgctttacgaaccctggcatatgtcgcaaaaaatccttacctaaagaactaactctgcagcctcttcaagctctagatttcaattcttatggcctaagaagtgtttttttatttcataatataagctttcacaacaatctaattcttggagtcagattctataaatacccaacatttactaacctacatttttttttcaattggtgccatgaccatcacataatgttgatgagctattccctccaagttgctgattgcatgtggattaccatgcatggctatttgctatttggttgtctcgacctttcttaggatctattggatgtaatacatattatcattatttagctaatatttgctaactactacctagcagagtggatagtaggttgtggtgtttatatccataactaatgggttaattaataattggagagtaatgttcctgttagcccccattgtttgggtagatagtaagataatggggatttagaaacaatctaaagtttattacaatctgttatctagacctatttatatccatagagctaaagtttagcagattgctacatcctcattattagtttggagccaaacatgtcctgattgtataatttaaatgtttataggagtaaccaatttgttttagctttgctattttacgagtgtcaagatgcttaactatttcatacttgctttgtaggaatgttcgatgccgacaacatcttgctctaccagaaggtaccagctccaaatcaagaaccaaaatttaggaaaaatacgaactgcaaccttatccgtcatctttagtaattcatgtgtttatcttatttgcaccaagaactatgctggaggctataaaactatgaatgttatttgtgacatgtaaataatactagcttgtacatgcatctaaatgcatataagaaacacaatgcaccttttgtttgcattccatgtaaattataaattaaatccaaacattgaaaaattacaaaacacacacacacaacactatgcgcgcatgggcgcgcgcaagacactagtacataataataacgatattgttcgcttcggattaaattaaaccaagcgagtatgcgtgcatgtgtacgtcggatgctttgtttgttcatttgtggcccgtgaagtaatatttgggcccaatagcccattcatccatgtcctaaccctagggcgcgttccttataaaacctatctccattctgttctcactctcagacaccagacgcagtcggctgccgcagactggtagtagcccgcgcgccgtcaccgtatcctcagatcagaggcgagcagaaaccacaccactctactgacgcccgacgaggtacacttccgcgcgcgcgcttctcttccttcttttttcgctcgacgaggtactctgcttcacgcgcgggcgcgcttctcttccttctcttttcgctctgccttgagcctgttcgtttgatgcccagatctactaggtttgtcgatcgtcgttatgtgtgatgagctgagccgattcatgcactgtatttttaattaagtgtttttttcctccgccgctacctttattgtctatgtatgaacttgcagcttacaactggttattgagccataaattgtaactgagtttccgagatctataatattacgtggctgaggcgcttcatctctgttttgtttgtatgacagtaggagtactaatccaagtttagcttccgcttcttcatctacctttagtatgtatttcgtatataaatacgattgcagtttgcaactgattctcggccatagatgattaccgttgcgttgttcatcgggtctagtttcggatctctgatgttgtgtgggtggggtacttcgacttgggttttcctgccctttgtttgattactggtttattgacatatatttatctattgactttttatctgctatgtttgatgtaagcagcagtgtaacattttcctgcag

SEQ ID NO: 54 - DNA, 1645 bp, Zea mays
caaagggcttttggtcatcagccgggagcgcctccatggccggcttgatgatgttggtagtggagatcttggtgtgatccttaaaaccggccatttatgggccgatttttagcagatctagacacctattccccagcggagtcgccaaaagtatgttgacgctttttcggagcgccaatcactcaagaagaaccggcggcggtgccctctgcacaggggcggacggtccgcgcgcaggggccggacggtccgcggcctggtgcgaggcggcggcgctctctggttagacgcggacggtccgcggcacagggccggacggtccgcgacctagtgcaggtgctcgggttccctgcctgacggccggacggtccgcgctctagggccggacggtccgcgcgtgcgcaggggcggcggaagatcgccggcggcgcctggatctcgctcccgggagggaccccgtcggggaggagagatcctaggagttgtctaggctcgggccggccgacctagactcctctaatcgacgtagagtcgaggagaggcagagaatttggggattggaatactaaactagggctaaactagaactagactagaactactcctaattgtgctgaaaataaatgcgagatagaagttgtattggttcgattgttgggggtcaatcggccgtagcccttcatctatataaaggggaggtctggatccgtttccaactgatttccgagttaatcccgcggttttaggtaacaaatcccgcgagaaactaggaaccctaactgactctgcgcacgcgcggaccgtccgcgccaccaccgcggacggtccggaccgcggaccgtccggcctccgggccggaccgtccgcacggtcattttgggttcgaacagagtcccaacgaggttagtaaatgtagtgatgaaattaagttttgtacgaagtttgtaaatttaaggacctgttttacataactattggagaagagttttctctgaaaaattcttaaatttatatttagggagttgtttatataactattggcatttgagatgctctaaggaagcgaaggaaataacttggcggcgatcctagtcgacaaccgttgaattcgtgagaatcaatcattctgtaggagtaaaaaaataaaataaaatatgcatttcctcgttcctatacgcttaaattagacgaccctggactggaaccaggaactaggaaggggcaccgatgtcatttgcgaagcaacaacaacatgcgtgaggacgaccaagtcaaacgttgcgtcgcgttgcctcgccggcgggccggtcccaccaagacgtggcgccatgcaagtgcgtcgtcgaccctcttctctctctctcttgtagtcttgttcctgttatctctctcggctgtccgctgccccgtgatctgagcgcgtttctctcccgtcctctcttctccctctcccgcaacaaacacctgctatccgctctccctctcccctgccatctctctctatcgcattgcttgcgcgagcgcagaaggcacacacgtacagcctaggtgatacctcctcctcctcctcctcctcctcctgatctcctctcctcctccggcctccgtatacctataactaaaagatgatcatcgtgcgatgcag

SEQ ID NO: 55 - DNA, 899 bp, Zea mays; identical to SEQ ID NO: 18

SEQ ID NO: 56 - DNA, 807 bp, Hordeum vulgare
gatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgc

SEQ ID NO: 57 - DNA, 1084 bp, Hordeum vulgare
gggcaagttaaaggccctactggtggcatgggtgggcaggctgaagaccctactagtggcatgggtggggagctccctgccaccatgtaatggaacctttatgatttactaccctttatgttgtgtgtgagtgtgacagagaaacctttctctgccttattaataataaataaagcacatcacttgtgtgtgttctgaaaaaaagatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaaccacccagatgacctctaccgatcgaccggacatgaatgcgctaccttcgtcggcgacgatggccgcgtacgctggcgacgtgcccccgcatgcatggcggcacatggcgagctaggaacctaggaccgtgcgtggccgccggctataaatatcccatggtcgtgagaccactagaaggaagcagcacctggcactgcgagagcgagcgtgcagtgagtagatagactagaccaacgacgacggcaggc

SEQ ID NO: 58 - DNA, 3064 bp, Zea mays
gctcgatccacctaggcttgttgcacatctttacccacaagtcatgttacccatctgccaaggggtcatgaatcccatacacctctaccatggaagcgagacagggtaacactacgaggcctttacaaagttccactagctttagaaaacccgctacaaggatcccccgtctgaccgccatcacagcaaaacccgagaacctccctacaccgaccactcccctactatccttgcccctttcgggtaagatagtcttccactagctttcctaattagtcagccaagggcgtcccataccacccttatggtagcactgtttttccgggtggtcgctccatgttccaattaacataataatcttatcatgaacaataaataacaaaaaatgataataaaagcatgatcatgaataatgtgtatctcaatacccaaaaccacataaagcaatagcaggtactacccaaaagttcagtggtaaacaaggtataaagatagtcaaactgggttgacctattgggtctcatcaaaattaacctatgcagatcataatgattaacagtaacattattgggtaaatagaagtgatcaagggcacaagttgccttcaacgagatcctgctcagcagtctccacctgctgaacacctgggtcctcagtggcttgcttgtctactcgcaacaatacaaacaaacatggtataggagaaattaacatcacaccaaacagcagaacagaatgcatgataatattctacgtgtcataacgagatggtaggaacaagaatcactaaattcagagttacgattttctgaagttattaggtgcttagtatagaataaatcaagtggataattttactctatgttttatggctaaacagagttaccaagtgataaacaatattaatacaaaattaatgcaactggaatggaccaaaaaggagttaaaatggattttctatgaattaatctaggttttggaattgtttttatactaaatattcattttctcggcttattattaaccctggtattttatttggactgcggacgcaaatgctagaaactacagggtccaatatatgaaaatcagggcatggatgtaattaatttacaatagcagtggacggcgggttaattcagtaattccctaggggcacttaagcaaatatccatcgcaaaggggtattgttggatcccgaccgttggatcagatccgaaggccgagaatagatcgcgcccacacaactgcgtcgtgcactgaccaccctccggttaagattcgacggaccaaatttaatgaaatccaaaccacccacagccccacgatcagcaatctacggtccctcttaacccagatgaatcggtatccgacttctaatctaagcagttcctcaatcgatcaacgctccagggccttcttctatctcccaacgcagatcgagctacggtcgcttgcacccgaggaacgccgacacagcgagcggcggaccagcggttctgggtaatgatttggagcacaaacaatattggcgcgacataggaatgatggcaactattaggttgtgaccttactagtgtcagcggtgtgggcagggtcgcccacgggaaaccagtgcgacggtgctcccggcttgttaatgacggtgtgctggtcccgacacggtgatgccccaaacgcccccgccgtacgagaacaccgcagacgcccctgctcgactccgccctcggcttcccgcgcccacctcgcacttcgacggccgcaccgaccctctgacctctccttttctctcctttctcactcctatcggtagctacaacagaagcgactcccaacgtggcgcaaaccctcgaagcatacggctggggaaggtggcagccaggtttatatcctaggcgcccgaggaaatcgtgtggacggctgttacgtttcgcccgcggggcgcgattcgcgcgaagaagactgtatgcgaggtagggcccactagcagtgagccatcacccagggaagcgcgcatgcatcgattgacacgcgaccccaacagtcaggcgacccgagtgtgcagacggtcgcgatggtgaaagtggctagctcgcgcggacgcgtaggggcattgggccgaaatgcgtttcagcggtccaacttctttttttcttgtctttttttctttccttttcctttctatttttagatttcaaatttaagttcaaattttttgtggtgaattttctaaaaatccacatatcagtatgaaaagaatttatatataaatctatttatttatatatttattttttttctatgttatttccaatttctaaaatgtaaattaggttaaatcgccatttggacactaatatatctttattagtattactattattatatgcacaaccaaataaactccaacatgatgcatcgattatttgtatgtcattggttaattattcactttaaatatgttccttaacgattctcatgaaacagaaggccatgcacataaagatgtatcccttttttctatattcccagagttgggtattacaacattcatctatgcattctaggatttcaattactctcaatcttttagtatttgttccttcattgtcaaatcacttctcatctaactactatgcttgtttaaccagcagaacaatactacaacaatatccatttataaaggctttaatagcaaactttacatattcatatcatgttaaggttgtcacatgtgtaaaggtgaagagatcatgcatgtcattccacataaatgaaaagaattcctatataaaaatgacatgttttgttgtaggtagtggaaattatctttccagcaaagaccatataatccgataaagctgataactaaatgtcaaaatcgagtaagtgccatatcatctatatcttatctgttgtttggaaaaagacaaaatccaaaaaaaaatatatgagatctcacatgtataaatagctcccaaatcagtagttaatacatctcccataatattttcagcattcaaaaacacaccaagcgaagcgcactagcaacgacctaacacca

SEQ ID NO: 59 - DNA, 178 bp, Zea mays
cacgtgagcttgcgatgtccactagggagctccatccactgatccacccccacgcggcgtggcgtcgtcattaacggcttgtggggaagggaacgagcaactaaccgataattagtaccagaccggccagtgaacgatgccaaaaccggcttataagctcagctgcgacaaccgtttt

SEQ ID NO: 60 - DNA, 330 bp, Oryza sativa
aagaacgaactaagccggacaaaaaaaaaaaggagcacatatacaaaccggttttattcatgaatggtcacgatggatgatggggctcagacttgagctacgaggccgcaggcgagagaagcctagtgtgctctctgcttgtttgggccgtaacggaggatacggccgacgagcgtgtactaccgcgcgggatgccgctgggcgctgcgggggccgttggatggggatcggtgggtcgcgggagcgttgaggggagacaggtttagtaccacctcgcctaccgaacaatgaagaacccaccttataaccccgcgcgctgccgcttgtgtt

SEQ ID NO: 61 - DNA, 246 bp, Oryza sativa
ggatcatgaaccaacggcctggctgtatttggtggttgtgtagggagatggggagaagaaaagcccgattctcttcgctgtgatgggctggatgcatgcgggggagcgggaggcccaagtacgtgcacggtgagcggcccacagggcgagtgtgagcgcgagaggcgggaggaacagtttagtaccacattgcccagctaactcgaacgcgaccaacttataaacccgcgcgctgtcgcttgtgtt

SEQ ID NO: 62 - DNA, 187 bp, Oryza sativa
tgggccgtaacggaggatacggccgacgagcgtgtactaccgcgcgggatgccgctgggcgctgcgggggccgttggatggggatcggtgggtcgcgggagcgttgaggggagacaggtttagtaccacctcgcctaccgaacaatgaagaacccaccttataaccccgcgcgctgccgcttgtgtt

SEQ ID NO: 63 - DNA, 163 bp, Oryza sativa
tgggctggatgcatgcgggggagcgggaggcccaagtacgtgcacggtgagcggcccacagggcgagtgtgagcgcgagaggcgggaggaacagtttagtaccacattgcccagctaactcgaacgcgaccaacttataaacccgcgcgctgtcgcttgtgtt

SEQ ID NO: 64 - DNA, 287 bp, Oryza sativa
ggtaccgagctcggatccactagtaacggccgccagtgtgctggaattgcccttggatcatgaaccaacggcctggctgtatttggtggttgtgtagggagatggggagaagaaaagcccgattctcttcgctgtgatgggctggatgcatgcgggggagcgggaggcccaagtacgtgcacggtgagcggcccacagggcgagtgtgagcgcgagaggcgggaggaacagtttagtaccacattgcccagctaactcgaacgcgaccaacttataaacccgcgcgc

SEQ ID NO: 65 - DNA, 400 bp, Triticum aestivum; identical to SEQ ID NO: 16

SEQ ID NO: 66 - DNA, 626 bp, Unknown
  Mirabilis mosaic virus
ttcgtccacagacatcaacatcttatcgtcctttgaagataagataataatgttgaagataagagtgggagccaccactaaaacattgctttgtcaaaagctaaaaaagatgatgcccgacagccacttgtgtgaagcatgtgaagccggtccctccactaagaaaattagtgaagcatcttccagtggtccctccactcacagctcaatcagtgagcaacaggacgaaggaaatgacgtaagccatgacgtctaatccccccaacttcgtccacagacatcaacatcttatcgtcctttgaagataagataataatgttgaagataagagtgggagccaccactaaaacattgctttgtcaaaagctaaaaaagatgatgcccgacagccacttgtgtgaagcatgtgaagccggtccctccactaagaaaattagtgaagcatcttccagtggtccctccactcacagctcaatcagtgagcaacaggacgaaggaaatgacgtaagccatgacgtctaatcccacaagaatttccttatataaggaacacaaatcagaaggaagagatcaatcgaaatcaaaatcggaatcgaaatcaaaatcggaatcgaaatctctcatct

SEQ ID NO: 67 - DNA, 357 bp, Cauliflower mosaic virus
tctggcgcgcctgagacttttcaacaaagggtaatatccggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaaca

SEQ ID NO: 68 - DNA, 510 bp, Figwort mosaic virus
cagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaacagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattccctctatataagaaggcattcattcccatttgaaggatcatcagatactgaaccaatatttctcactctaagaaattaagagctttgtattcttcaatgagaggctaagacc

SEQ ID NO: 69 - DNA, 554 bp, Figwort mosaic virus
ctcgagcaagtgtacaaaaaagattaccacggaagaaattcacaaggtaaaactttttgagaaaagattgatcaacatcaatcaaatcaattgtggagaccacacaaagaaattgtggtgtaaaattctacagaaaaagtacgaagagcatctttgccagtactgcagtggggaccacccacgtgacaacaaagaagtggcagacaagtcacctcaaagtggaacccatccacgtgataaaagtatcatggcagacagccggtacaataatggggaggacagcttgcaaagcagcccatgtggaagcccactcacaaacgcgtattacgaacgcagtgacgacatccactcaagaattccatctatttaaagacggattcattcccatttgaagatcatcaatactcaaccaatatttctcactctaagaaataaagagctttgtattcttcaatgataggctaagaccctaaagagtctcgaaagagacatgtagtatagtaagagtcctcccagtccgggagattgtaataaagagatcttgttaaggatcc

SEQ ID NO: 70 - DNA, 299 bp, Unknown; identical to SEQ ID NO: 17
  Agrobacterium

SEQ ID NO: 71 - DNA, 711 bp, Unknown
  Agrobacterium
cctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcagga

SEQ ID NO: 72 - DNA, 708 bp, Arabidopsis thaliana
atctcgtctctgttatgcttaagaagttcaatgtttcgtttcatgtaaaactttggtggtttgtgttttggggccttgtataatccctgatgaataagtgttctactatgtttccgttcctgttatctctttctttctaatgacaagtcgaacttcttctttatcatcgcttcgtttttattatctgtgcttcttttgtttaatacgcctgcaaagtgactcgactctgtttagtgcagttctgcgaaacttgtaaatagtccaattgttggcctctagtaatagatgtagcgaaagtgttgagctgttgggttctaaggatggcttgaacatgttaatcttttaggttctgagtatgatgaacattcgttgttgctaagaaatgcctgtaatgtcccacaaatgtagaaaatggttcgtacctttgtccaagcattgatatgtctgatgagaggaaactgcaagatactgagcttggtttaacgaaggagaggcagtttcttccttccaaagcatttcatttgacaatgccttgatcatcttaagtagagtttctgttgtggaaagtttgaaactttgaagaaacgactctcaagtaaattgatgatcacaagtgaaagtgtatgttacataagtggatatttcaccctttttccatcaatcaaaacatcatatagtaatccattggtttatacaaacatcaaaata

SEQ ID NO: 73 - DNA, 250 bp, Arabidopsis thaliana
agccattctctcgcagatgatgttcactttgtgttttacttcctttatgcattcacagcaataaaagaaagaaatctccatcgcttttggttttcttctctgtcttaagttagtcgttttcgtgtctaatctattacttatcattgtaatagactcttcttctattgagatttgaatataaactaaaacacattccattttactgtgttctcaacattcagaatgcaaacggactaaccgtagtgactcg

SEQ ID NO: 74 - DNA, 480 bp, Nicotiana tabacum
aaagcagaatgctgagctaaaagaaaggctttttccattttcgagagacaatgagaaaagaagaagaagaagaagaagaagaagaagaagaaaagagtaaataataaagccccacaggaggcgaagttcttgtagctccatgttatctaagttattgatattgtttgccctatattttatttctgtcattgtgtatgttttgttcagtttcgatctccttgcaaaatgcagagattatgagatgaataaactaagttatattattatacgtgttaatattctcctcctctctctagctagccttttgttttctctttttcttatttgattttctttaaatcaatccattttaggagagggccagggagtgatccagcaaaacatgaagattagaagaaacttccctcttttttttcctgaaaacaatttaacgtcgagatttatctctttttgtaatggaatcatttctacagttatgac

SEQ ID NO: 75 - DNA, 250 bp, Arabidopsis thaliana
atatgaagatgaagatgaaatatttggtgtgtcaaataaaaagcttgtgtgcttaagtttgtgtttttttcttggcttgttgtgttatgaatttgtggctttttctaatattaaatgaatgtaagatcacattataatgaataaacaaatgtttctataatccattgtgaatgttttgttggatctcttctgcagcatataactactgtatgtgctatggtatggactatggaatatgattaaagataag

SEQ ID NO: 76 - DNA, 1000 bp, Glycine max
gctggagctgatttctgtgtgatgttcgatgttggattttcccaaacattttaagaagaaatgtgatgtgtaatgggtctgtaatgacctttgaaaataagtttggtttgtgttgaactctattgtcccattaatgttactactgtttgttatcaatttgtggagctgatatataattatcaactgtatgctggcatattgtgtttgaattttgttctcaatccagtgaattggcgtatattagtgggttttttattcttcatgcttatcacggaggaaaagcagggatgagttgtgtgaaggatggtgatcatcccacgaattattagattttggtattataggttaaagatatttattaggtagggagaactcttggattagattctaaagtgatattttgaaaacacaccaaaggatttttgaacaaacggagatcatgatccctagtttcaattagctgccccttaccaagaggtagcaacttaaaaattatgctcgtgaagcatatttggtatcgtatataaattatgtaagcaatctgcttcagttggaacattaattggcttgcggaatgcacatttagatgatccacacaggtccacataaaaattcctaatcaattttagttatgcaatctttctgcttcaggtagtccttgtcttacagaaagcacattgagatgatccccacacagatccacataaaaaattcctaatcaataataacttgaaaatcattaaaagatgtaatgccatactaatccctaatttttgtgcaagtttttgtatactggaccccaaaaaataccaaaaagaaaaaacaagttattcagtgatatttttctgctccaatataaatttgattaccaaataccaaaaaataaaaacactattcagtggtatttttctgctccaatactggaccccaaattaatcagaatcggatccgtttaacagataaaaacaaaagcgatcgggttaaaatcccatttttacaa

SEQ ID NO: 77 - DNA, 1000 bp, Solanum lycopersicum
gttgtggttgtctggttgcgtctgttgcccgttgtctgttgcccattgtggtggttgtgtttgtatgatggtcgttaaggatcatcaatgtgttttcgctttttgttccattctgtttctcatttgtgaataataatggtatctttatgaatatgcagtttgtggtttcttttctgattgcagttctgagcattttgtttttgcttccgtttactataccacttacagtttgcactaatttagttgatatgcgagccatctgatgtttgatgattcaaatggcgtttatgtaactcgtacccgagtggatggagaagtgctccattgccggtttgtttcatgggtggcggagggcaactcctgggaaggaacaaaagaaaaaccgtgatacgagttcatgggtgagtgctccagcttgatcccttctctgtcgatcaaatttgaatttttggatcacggcaggctcacaagataatccaaagtaaaacataatgaatagtacttctcaatgatcacttatttttagcaaatcagcaattgtgcatgtcaaatgatttcggtgtaagagaaagagttgatgaatcaaaatatctgtagctggatcaagaatctgaggcagttgtatgtatcaatgatctttccgctacaatgatgttagctatccgagtcaaattgttgtagaattgcatacttcggcatcacattctggatgacataataaataggaagtcttcagatccctaaaaaattgagagctaataacattagtcctagatgtaactgggtgacaaccaagaaagagacatgcaaatactacttttgtttgaaggagcatccctggtttgacatattttttctgaatatcaaactttgaaactctacctagtctaatgtctaacgacagatcttactggtttaactgcagtgatatctactatcttttggaatgttttctccttcagttatacatcaagttccaagatgcaggtgtgcttgattg

SEQ ID NO: 78 - DNA, 1000 bp, Pyrus communis
gtgctggatgtggccggtggccgtcttctacccgttttcgttgaattgtttatgtttttactgtttttatgtatttaagtttgatggtactgtttctgcctcctgattgaggcatatggacaagtttggtttatcttttactatgttttgataaataaattccgttctggttaaaaacttcgtgtttgaaatttgttgtgaatctcttggtttaatttgtttgtttgcatggtgttgtgtttgtgaatggtttgctttcaatcgtctgtttaatgttgattgtgtggtgcggttgccatccttgaactggacctttggtacaagactggcatttcaaggtgtgcctcaatctgtggtttcgattgtggtttcagattttccggtgagctcactctagcgtccggcatttaccccaatcagttttccggcacggagagggaaattgatatttaccccaatcagttttccggcaacggagagggaaattgatatatcggagtgaaggtgtccgactcaactatggcaagcgtcactctagcatccaacatttagccgaaaacctaagactttgacacccaaaagaagagatgctgttgagtctattgaaaacacgagttacaccagttgtgtggaaagaggagacgtgccgtgtccaatgtatgctaatttgcccctcatatctgcagccactataggctgccgatgaatttcaccgtcccctgatgtatattttcagtacttgtccacgtttgaatattgacatccacgtttgaatttcgctatcctggtgcatccgctcccgactctcttagtcgagttggaaaaacccaaataagttaactggctttggaccttctgtaaacgtctatccatttagggctaaccgcgtggttttgttacaaaatcgctttagacctcccgtttatatctcggaaaccatttttagcgattgaattttatcttttgtacgaaagtattggacatactaatccgaagttag

SEQ ID NO: 79 - DNA, 1000 bp, Beta vulgaris
gcttgtggtggttcgtcgttggttgttggccttggaacaatggctttgttgggtgtttatccccctataatctgtgaattcatctatcatctagtttatgttgaacaattttaatttcagttggttatcaaatgttggttttatatcgtcgtatgtctgttgggttactatgaactattaaggttcagttgtgaataatattctctgtttgtgtctactttgttctccttttgttgcaactatgtttttaatgtttcactttatcttcctgatttctaagtggcattatcatgcttcatgccttgccttgtggagttgtggagtatgtttgattatattctccagaatgatattgctcagcttattgttacctaactttttgtctggctttttatgcttgttgattgtagataaagggaacaaaatttgtgttcacatagtatgcacacattttgtgtttgcagattgtgtgccatttatcttgctacactcttgtttatggttttttttggttgtatactctgttctcatttgtggtttcacctaaaacaaatgtgatgattttggcaagggggtgcatctctgtttttctggttgtttttttttttttgatgaccttgagtgatggtggtgttgatgtatgcgaggagtcgaggactgatgcttttgcacatatgttgtgtctattgttctggcttgtatgcactgttacggtatgtcttgtgagctattttgaagtatatttgtaattgaacattgatctgagagttcgggctggtgcatcttccattactaccaatgttacagcattgtaggagttccgttagtgtgttgctgatcccttttgatatctttgaaatgtgattcataacataaatgccgatggggaaggaaagatatttactgttgaatctaaatgtgaagagatgctatgagcctaatccattttgggtaagcctcacctttgctcataagctttatgagtcccactgctgaaaat

SEQ ID NO: 80 - DNA, 1000 bp, Unknown
  Raphanus raphanistrum
gtctctcgtcctttgtcttatcaaaaatcaacaatgtctgctttttagtctcgttttctttaaaacttatcatggtttgtgtgtttgaggcattataagcctcttttgaataatcgttgaactctgtttctctcttttccttgcaagacttttctatctatatcctcgttattcttaaatgctttgtgttcatctttcaaattttgaggttaagttgtcgatgcggtgaactttctatttttgcttagctgttacttctgaaagcacacctgtaagctttaacgtgttcacttttcagagttatgtgaagttttttagaacgttcagtctgtacttattggtcgtctctacaaggaatcgtgtgacaaaattgtctgttaccactagcttgacaagtatagtaatttggagaattcatccttccaaaagaggttatcagtgatgggttagtctcttggtcttcatacgcaaaattgaatctggtgaacaacagaggttagtcgagtttgcaagttaattggccggatcataggtcgagtttgcagatcaatgggccagatcataggtcgtaattgactgttttatatcgctggatcacttcagtaagaaagaactaccaaagagttcagtgaggtcttaattgacagatatgtgaactaaaattaattcagttgctcaaataatgtttaactgcatcaaacgttttagtggtgctcgttttattgatctaaatttaaatttgtaaagagttttaaacatggtgatttatttggaaacacttttgaatgcattataaagtgtaaactaggtgttttgccggcattttcagatttaatagtttctagaaaaattataaaaaggtatattataaaattcaaaaatcttaggataaaatattggcccatttgggtgaaaaaccaagaacgataagtttattaggcatgtatgcaacacataatttaattaggtagtcgtgcagaactctagaatcgaatttact

SEQ ID NO: 81 - DNA, 1000 bp, Ipomoea nil
agagcctcactgtcctgtttgaattgcttggtttgtgtgttaagtgccaaagctatagtaacttggcactgctggtgaattgtgtttgttttgcttttggttgatgaacccatgaaggttatgtttccttgaataataataataataataatagcattactattattattattaggtcctactattttgttagccccatttgttctgaactctgtttacttttagtttaatgttattaatatattttaccaggtaaaatgtaatactattttatagaatactttcgttaaaaatgagtgttaccttcatatctatctcaagtagtaatcaatttgagatccgtctactgggagcaacatagcattggccttcacgagaaggaagggacattattgctccaaccgtggcaggagacatttttataaataataatctgaactttataaataatttgaacttacgtgcagcaacatagctaacaataaagactacatctctaggctctagccaacaataagtgctttgatgtaatttgattataattgtattgcaatttgtttagtcaacaataagtgcctttttggttggatgtaatttaaatgtaattacattgcaattcacttttcccatcaattacgttattcaattgaatataattcatggaccttatttaagaattacaattcagtggtgaaatggagaaatatattattgtgaagacatttttaccattatcattacttatctcatgtcgcccaccgaattacaatttattctccctaattcctttcttccaactaaaccggtaaagacttcatctcatactatgtgaaactacaaagaaaggtttactttttacaaggcgtttaagttggaagaagagaattaagaaaaaacgagtagtaattttgttggaaaggaatttaaattatattgtttgataggaaaaaatataataattcttaaattacattgtttgatagggaagaataaaatgatt

SEQ ID NO: 82 - DNA, 1000 bp, Unknown
  Cucurbita sp.
attgttcttctgaagatggataaatcagcatgcggggtggggtggccttgttgcggccatttgttattttcttctgttctctacttctggtgttatgtttttaaatgctccctgagggttacagtatggggagaatattaatataagatgtcatatttcaaataaaaatttcgtttcttgtttaagaatcgtgtccagacttctcttatccagattctcctggttgtttgtcattggggatgatgatgactaaacatggttgaagctttgtcctttctggataattcttaattcatgatgggacgaacacaatcccctggtcgtccagagaattgaatagctaaggaactctttagtggagtcgaatcagatctgaatcagatatggctgccctctccttttcccccaagaacccgaaatctagttcatctcccccaggtccatccccgttccctgtgcctatctccaaaagtcctccagtcttggctacagcttaaattatcatcagtgctagccattttgatcatatctgcaaaaagttgatttcggcggccatgagtgcatctgttaaaacaagaatgtgtattggggaaactcacttcatctccatcttgggaaagtgggaagatttatggggtttctaggatacctaacttagaagacataattgaagacaacatattattagtttaacggtgaattggaaaggctttcatatttcttgtgagaggctttcatatttcttgtgagatcccattttagtcaactctctctaaccaatacaacttctccttaaccaattcattttaaaatgtgagaccgacgacaataactgttcaagcagcagcaatggtggtatgcaggtaggaaggaactctattatctttgactctgagtttcaactattaagtgctttatctgctactcaatcacggaatcgattctgtctaagtggaaagaaaaagaagaggaagttagtgagcccacaccctccttttat

SEQ ID NO: 83 - DNA, 1006 bp, Helianthus annuus
atgtttgtggtggttgtgatgtttgaagttggtactgttgttggtttttaaatgtctgtggttgtggttaatgtttgaagttggaacaattgttggatacagattctctatggtttccttctatgattgttgaataaatgaattttatggtttaatcttgggtttgatcatggtcattgttataaattgaagtctgggttgcatattctgaaaatgatttgtcagtagtttattgtttggtttaaatgttgattataacgaaggtagtttatgatatgcttagcaactgttttgtaaggacatagtgatttgtgccaagaccaaaagttcaaagtggtaggggtggcgtgaaaaaaaaaaaccaattttaaagggctagtgctcttgaccaataaggttttgtcatgtcatgtgggttgtctcgctcaacgtctaggctgaaaccccgcccaaggagtcacgctgaaacccaagcccaccataccactttgaaattcccttttggtcttagctagcaaatataccatgtccttacaaaacagttgctaagtcgttttggcatgtgtttctgtgtctgaagatatgttaattgcatatttcataatcatttaagcatagaaacgacggaatttaataaacacagatcaaattatttggtatttttggataaagtcctttttgagtctttgtggtgtgtgcattttaactatttttgaatctaaaaatcaaacttgtcttgatttgagtccctgtagtttgtatttttaacactttgattccccgtggtttgtatttttaaccttttgaatcaaacacttttagtccatgatttggatgaggtttgcgttttggattcaaagggttaaaaatacaaacctacaaggactcaaatcaagtcaagtttagtttttggattcaaatagttaaaatgcacaaaccacaaggactcaaaaaggactttactcttttggatataacaaagagtttcttaaattcctctgagctc

SEQ ID NO: 84 - DNA, 306 bp, Pisum sativum
gttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgt

SEQ ID NO: 85 - DNA, 469 bp, Pisum sativum
caggcctcccagctttcgtccgtatcatcggtttcgacaacgttcgtcaagttcaatgcatcagtttcattgcccacacaccagaatcctactaagtttgagtattatggcattggaaaagctgttttcttctatcatttgttctgcttgtaatttactgtgttctttcagtttttgttttcggacatcaaaatgcaaatggatggataagagttaataaatgatatggtccttttgttcattctcaaattattattatctgttgtttttactttaatgggttgaatttaagtaagaaaggaactaacagtgtgatattaaggtgcaatgttagacatataaaacagtctttcacctctctttggttatgtcttgaattggtttgtttcttcacttatctgtgtaatcaagtttactatgagtctatgatcaagtaattatgcaatcaagttaagtacagtataggctt

SEQ ID NO: 86 - DNA, 1000 bp, Helianthus annuus
aggatttaagcttgtcttatgtttgaactcttgtgaaaggtttctgtgacgctactttttaagtgttggtgcaaatttaaataaaatcatggttctataaatacgatgtttgtatgtaagtttgaacacccaagttcattcaggtttcaacagatgtgcttatttaagtacacattggccacgtcatcaagttctcgtgtttgtgttgctttgatctttagttgttcattgcacgtactttggttattgagttgtacaattacaagtacggttacaaaaatctttttagatacacatcaggatgattatcacaagacaaatataacaatactgatgttgattgagcaaaatataaaaaaaaaagccatcatactaaggggctgtttggctaagcttattttagtgacttatttacttatttactttttaaaaagttaaaaaaggtgtttggattagcttattatgtgagaggaataagtaaataagtcattccaataagcttagtcactttttagatacacatcaggatgattatcacaagacaaatataacaataccgatgttgattgagcaaaataatataaaaaaagccaccatacaaaagctaagttttagtcgtgttactagccaaatttatataaatgtgtaacatactctttaagatccatataaagttgaactcaaaccactttattttccctcagccaccatatgactagaagacattccagacgacccctttgaagacatttaggctaggatcttcaaccttactatattagaggccgcagacaattgcgatttttatacaaacgtcattattatatgctaaacgtataaacaaccaaaaatttctcaaaatgggcattatgtcaaatctatagctcacacaatctttcctcacttaagtgtcagagcacaacacaagaggctctcacggtatctcctgcttgtgtagtgtggttaacgagttgtacatctatctcaacgacactttgaa

SEQ ID NO: 87 - DNA, 999 bp, Zea mays
ccaccggtatctcgcttccatttcacaccccacggcctagctataaagactaatggttccaggtgtctgaagtactgaagacaggggggctagctatctaatgtttgtgccgcacgcatgagctgtaaggaggccatgcttaattattctgttgccgttgctactctatctatatgcgcctatgcctccgtgcatgaactatgctttaggtggttgctgctccacactgtggtggtgtgcttttgcttttgtgtggtcgtattgtatgcgtaacctgacagatggatccctgattgctacatgtttgaataatttgcatgatctagctagtttctgcctaatctaatggtacggctcatgtcttgtcaggtggatttgttatgtgttttttttttcaaattgaggcttgtttgttttgctctcaatccatccatgtgaattgggtggaattaaatgagtttaaattccaaagtcagtcaaaatctgttataattcttccaatccataaccgaagatcataggccctgtttggaatccctagaactaatagttagctagctaatatattattagtcggtatgagccggctctaataaactaattgttatttgtgagataactaacaattactaatagttagctagctaatatattattagctggtttgagccagctctaatacactaattgttatttgtgagataactaacaattaattatgatattagctgatgatgtttggaacctaacaactaatttttaattttatttctataggttctaaacaggaccttagtggctagtttggatacactaaagtgtcgttcggttgtttgagatcgatggatcgaaacgattactaatcagattacttctctaatttatataaactttgattagctaaaataatttcgggcgcaatctggtacaaacgaacaagccctaatcaggatggcatgccaatttggattggtgtggggtcacgcatggtgaattatg

SEQ ID NO: 88 - DNA, 1007 bp, Oryza sativa
ttcttcggacccaagaatgctaagccaagaggagctgttatcgccgtcctcctgcttgtttctctctttttgttgctgtttcttcattagcgtggacaaagttttcaaccggcctatctgttatcattttcttctattcaaagactgtaatacctattgctacctgtggttctcacttgtgattttggacacatatgttcggtttattcaaatttaatcagatgcctgatgagggtaccagaaaaaatacgtgttctggttgtttttgagttgcgattattctatgaaatgaataacatcgaagttatcatcccagtattttcgcatgaatgttcttttcttctgtcttgtgcatcagtgatctagtgcatgggagtttgtattgtgatgttcgacatcacgtaacttccactttgcctttgctgttcgatattttaatgacatgtcacacacacttctgatacttttctttcttggctattgtgccagcatgatgcaagatgcatcacagcatcagatatattctcatcgtcaggctttagcagcacacgagcacgctttgccgcttaaaagttgtacggcgcagcttagacatcccctgtagaagtgataatcttttcacttttccttaaacaaattgagaggggaaatggaaccatgtggatcagagaagcttttgtttctttacacaagaatatttggtacagtgggggtcctatgttcgtgggttcgtggcttggctgcctgtcttcaaccaagtgttttcagttcaacatgttagcgtgtagaaagagcacaattctgtttatctccaaggtaaaatgtggcattctgttaaagaacatgatcctgccaattttttaagtttcaatggaagaggaatgtaaagctttctatggtttgtgtacacaacacagtggaagaggagtgcaagctttctatggtttgtgtgcgcgttgtgtgtcagcacttcaattttgttagaaaatgaaagaaaaaaaaggatg

SEQ ID NO: 89 - DNA, 1000 bp, Oryza sativa
tcagccagtttggtggagctgccgatgtgcctggtcgtcccgagcctctgttcgtcaagtatttgtggtgctgatgtctacttgtgtctggtttaatggaccatcgagtccgtatgatatgttagttttatgaaacagtttcctgtgggacagcagtatgctttatgaataagttggatttgaacctaaatatgtgctcaatttgctcatttgcatctcattcctgttgatgttttatctgagttgcaagtttgaaaatgctgcatattcttattaaatcgtcatttacttttatcttaatgagctttgcaatggcctatgggatataaaagattattctggagggaagtgatgctggaaggactatgctgtcctgatttatatttggagccactatgagcatttgggctttcttttcagaacgctgtaggcgtgtgttgaaatctttgcgacattcaatttgatatatgattcgaggtaattgggctttaatttgtcatctcatgtaacatctttttgtttcttcgctgcttgatttctctatttcgtagcattggaagataatagtagaatgatgatatactccaatacttgcaatttcaaaaccgttagaaagaaaggaaaatcacggctaggggaaaaattctctctgatgcgtgcatcaccaaaatctgattgattgacataagcattggaacacaaatagaagatggagaggtggacatgtttccgagacatagcatttgagctcacattgtttttgatccgtggctgtgccatacgcgataatttactaaactttcccttgccccttggtaatataaagcttataatgtatacaccgaaattgaaaaacgtattagttcactcttcttcctttttctcagcaaagcgtgttcatcaattttattccacatgaatgtgattgcgaattgtgaccaggaatgcatgatttaacaatcccgatcaaccctgttgtcggtggtggcactaaaaatta

SEQ ID NO: 90 - DNA, 1000 bp, Oryza sativa
gtcctcagccatggagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaagccaaatctattctgaacttttgaagatctgtgatgtccggaagaaaagattcaaacagataaacgggactctccagaatctataaaataaatgatcgacaaacgctttgctttggtaggcttctcattaacccaaacattctggaagaccaatgctgga

SEQ ID NO: 91 - DNA, 1000 bp, Aegilops tauschii
gtgcctggcaatggagcggcttctctgcgggttcacaggtcttgtgtcttcgatatgtcctccaatggtgcatgtgtctgtcgtcctggtcgtttctatgtttctatcgtagtgtgctgcatcgttatgttcggttgtatttgagaactgctgctgttgtgaacagctttggtgaacttgataaataagtgagcccctaattgtgtctgcagctgctgagttatcctgcgttttcttttgtttgcttctatctgatgcatttcatctctattcatatgaatattgtaccttgcatttgttagttcgactatatggtactttgtggcaattacatcttggttatcatagaggcttcactcttttgaggagtagggattgggagggaccggactatcattagagataaccgtatcctgtttgtcgacaagcagcatggtcgggcactccggtgggatcatggttgaatcggactgcattgatgtcgtcgaggtgatgcagcaaggggttaaatctgtgggcgatctttgaggaatgtagtttcttatgccgtaaattttgatcatgtcttgttcaaccatgtcctgtgaattgaagatgaatccttagttgtcaatcaaaaggataagaaaaacgatgttccatatgtaataatttgttcataaccaagtaaaagtatctgtgtaactagtagaaaattcagtagatcagaacaacatatggtaccaacccattttgtacatcaaggttgattgaaaaacattttaaggaaaatctgttgtgattctggtgcgccaactacaaaattatgtgtgtgccttatattataaggtgagaggcatttcggcaatgcaaattgtgtggaccttcatatatgtattgactttttttttgcgatgagtattgactggtttattaagtgcatgaatccctaactttcaccatatgcacaaaacttctgagggttatgtgggcattatgccagccagaccgaatcaaatgc

SEQ ID NO: 92 - DNA, 1000 bp, Unknown
  Panicum hallii
gtcttgggccatggagctgctgttgtccctgggctcacaagtctggtgcctgccttgtctctccaatggagattgtcttggtgtcctgtggtcgtgtccttgtcgtgcctgtctgatgtgagtcatgtcgtctggttgtgttttgtgaacacttgctgctgtgcagcagtttggttgaactatgcaatgaataagtgagccctgaagttactgtggtaatcttgtcttctggatgagtcgtcattattatatggtttattcatgtttgtgaagtggaagcattaatttcctcctggtgcgttgcttttgcagttctgcttgtgtcgtgatgttactggttttgcaagtatgctgcttccttgatcgcaacttcattttgggtcattcttcatttggttatgctggtgctctggttttagattcatcatatatttcagattaatgtagtgtttataggaactatcattttaaattttcccagatgtcatttgtgctgcctggttgttgcatacggcgtggttgtcaaggcaggttaagattgccgatctccttttgatccttgctatctccagattatttggaagattttttttgtttcttgaacaggtagattggttgcagctatgaattcattgaagctatggtgcccaaaatgtcatgtgctccaaattttgtagccattttgcagatgtagcaacacgttttcagattatatagtactgcatcaaaatcaaattgttggcgccatagtacattactatcacactagtaatgaccaggaacaatcgcagccagttaacatgccggagtattccacatggataaacaatggtgcatttcttgaggagttgatcagaaccactgaactgccaaacatgtccgcagaaccatgacaaccccttgcatgaagatgtgctaaagttgttgacagaaagtccaaactctatgatatgcacacattatcagcaagagatggggattgttatttgccaaaaatttc

SEQ ID NO: 93 - DNA, 1001 bp, Zea mays
ccgtcatcgtccatcaacgaccaagcaacaacacatccacactatatactcaattcacattgcaatgcatcgttattattacatcatttatttcagaccccccgcccactgctaaccgtagtccataagagattcatcatccgtggactatgctcgatctcttccgtacgatacaattctcaaatatttctatttatttcctaagtgaattattatatatgtactatttcattccaggttcattttacttgtgaccattcttcagttcttttttctgtaaggatcggtatatcggagcatatgtgcatggctatgccagttgttgggcgtaagaatgtatttttttctgtaatatagaaaaaaactattttaagcaacaggttattgtcaagttactttgcttgtgaacaaatttcgtaccacgtatatatttgtatgacctttgtataaaggtgacacgcctagtaacattaaccaaacaccgaggaaatattaattctcaatccaagggaactcaaggcggttgagaggatttttagggctgattcagtgatcagagatcccgtggatcccctcaggatccctgatcaccaaatcaacccttaggctagtttggaaactcaaatctcttttaggattgaagaagattggagagaaaattagttcatttccacctcaatctcatttaatcccgaaggggatttgaggttcccaaagtagcccttactgggataaaattccccttaatctttttcaaggctactttgatgacaatggaatttagggagaaaatgaactaattcttcacacgatctcctccaatcctttttaattctcttatatcaccaaacaaggcctcaatgtccttggattggcgaggtcatcccattttatctcgttcacaaaaacaacagcgacattaatagacttaaaaacatttgagatgtccacggagatatgaccaaccggaaacaagtgatattcatggtagctgtccctac

SEQ ID NO: 94 - DNA, 1000 bp, Zea mays
tctatctgtctggtgctgtgcttgcttgttggttacctcgtggaagcttaaaatatctcgtcttgttgacatccttgcagttgtcgcgtgaacaagtaatctatgatggcaatgtttgcctggtcatgaagtattattactttcgttgaaaccgtgatgctattaagacttaatttttttatggaacatcgaatgtaaggcatacatggttatgagttttgtactaccctttgcagtgtgttcctgtttaccttttgtgctgatgattcgcttgtctttgtgtcttcaagttaatcttgcacttaactgtttttaatatgccagatcgtttcaaaagatttgaaatttggattcttccgaaacgtttttttgataataatgtagtcctgaaaacatgattttgattcttcagaaactatttttgataaataatgtagtcctgacaacatggtcaattttacgcttttagttatcaatgcatttttcatgatttccgaaagttccgctccaaccttttcgaaatgccagcatttgagttgtttttttttctactttttccgatagcctgaagtctaatttagttgcaaaaacataaatgtggagtaactagagctgtgtctaaggggtaagtgtaaaaattgccaagagccctttttgaagaaggaatgtttcatgctctacgatggaggcgaaggaacatctctacgttgatcagatagcggtcgtctcctccagattcgctgtgcttcgaagatccgcgatcgattcctgctccactcaaggtcacctccactcgagttctcaagcctatcctcttcctctccctgtctctcacctttcctcttccctgcaagatggatctgccggcggtggctgccatggtgaggtcatctccctcatacgaccgtggctgctacaacacaagctcgggtgctccgtcgcctaaggagatcccgctgccaggcgcccgcccgccattcatccatggtggttcggccgc

SEQ ID NO: 95 - DNA, 1107 bp, Zea mays
tcgtcatcgtcctactatcaagcaacacgatcgaccaccacctcgattatatatgcatcattatagtatcgtttattaatttcagacccacccactgctaaccacatcgtccacgagagattatattcatccgtggactacgctctcgatcttacaatttgaaacctttctattttcctaattactatgtattccaggttcattttgattgtgaccattcttcagttctttctgtaaggatcggagcatattatatactctatgtggctatgccaattatattgttgggtataagaatgcattttgtttctgtaatacggaaaaatatattttctttaagcaacaacaaggtaaaaacttgcctcgttgcatattttctttatgtcaatctccttttgttcgttgtatgatcctctgtttggaaactgaatactgatcgaacaactgatcaggagttaaaacatattgtaaatatatataaaaacttgctgtgtacaactcttctttattgtataagtttcttgaggtaaccgaaatagatagtaaatcccaatacaaatagattcctccgttactaactaatctgaacataaatgctaataaaaaaagtataaatttctatctgcgtatgtaccttgaccttacctttattctattaactcctgattttctattcagattttgaacggtctgttacttcctttctattctgttctggtttcgtcgtcgtttgtttccgaacggtctgctacttctgattttctatttgttcttacgtttggttttgccgttctagtttcttgcgtttttccatataaatatagaaacacaaaataaatgtaatgttgtagatacttgaactatcgatcttttcctttaaaaaatgatattgctaccactaatgtagttttaattaggaacaaaacttacaaccaatgatcaactaatgaaccggtctagaacagtctatatggacatggtgagcaagcgtacgtaattccgggaagcacttgtcgtccggacgcaggctacattactacatagtagcaaaacaaattttattccgataatattggttgctatacagacctctgcagacaaaaataa

SEQ ID NO: 96 - DNA, 1000 bp, Zea mays
gtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctgcaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggatt

SEQ ID NO: 97 - DNA, 1000 bp, Hordeum vulgare
ccgcctagccgatcgagggctccaggcacgcatgcatgttcctgttatgtggatgttggaataaaatgctggtgatctatggcggctagcttgcttcctggctagcagctgctgtaatgaaatttgtgttgcaactttttttttagtcccatccagagctcttttcttttctttaatttgctgtagtaatcaaagtaaggtaggtcgccagaaaaattgagttgggccagttaattatgggggaatcgatttgatccgttggatgacacatcttcttcctctagtcggcttcctcctttaaacatatcagtatcacatcgcctgctaccgcctctcacggccgcctcaccgcaccgcccttccctgaacctcccccaccgccgatcttggtgccgccccatacaatccctctaagtccttcgaccacccaaaaaaactccggcgagagggctccaggcatgcatgcatgcatgttcctgttatgtggttccaccgatgatgtgggaataaaatgatggtgatctagctacaggcggtcaggttgcttctttcctggctgctgctagtaatactttttagagcctcttttcttttcttttgctactagtaatgaaactaagttaagtcaccaggaaatttgaattgggccagtcaattccgggggaatcgatttgagccggtggatgacaaacgaacggtgatgctcgcgtcttcctctggtcgatttcctcctggtattctagacgtggtctggccgattcaccgattccaaatatcactttcacatactgaaagaagcaacttcacgaattgtaaatcagcttcactcactggaaatatgagttacacttctttgaaaaaacggtttcacatttttgaaataatcgtttcaaatatttgaagaaaatcaattttacgtattaaaatatatgcttcacaaagagaaacaatccctttcacatatttgaaaagagaactgcgttccacaaactgaaaatat

SEQ ID NO: 98 - DNA, 1042 bp, Zea mays
attacatatgagatgtactcgacaatggtgccctcataccgacatgtgtttcctagaaataatcaatatattgattgagatttatctcgatatatttctgaactatgttcatcatataaataattgaaaacatcaaatcataattttaaactcatgcttggtcaatacatagataatacaatattacttcatcatcccaatgatgtcctagcccaacctattgaatgttaatgtttggttgtgtgagggtgtgtttataacatagatgtgattatttgcgctttttgttgagtatatacatatatggtatgttgatttgatatagggatggacacatgctttggccttggatattcaaatcacttgtacttgcacgaagcaaaacataatatatagtttagaagtaaacttgtaactatgtccaaacatgctcacacaaagtcataccgcattataattttttggtaaatattcaacacatgtattttttacaagaacccaaattttacagacaaatgcagcattgtagacatgtagaattctttgaagcatgtgaacttaacaacaccaatgtcattaaatcaactagaccctatgagtaacaatttcgatattgcaaacaccaaattatggaacttatttgctgaaaaaattatgatcaatgtgaagtttaaattattataccataaatatatcaaagatttttttgaggaaggtaaaaattgcatggaatgggctgcccaacgtgatagctcacttttatgctaggtagcattaccaaagatgggaacgttctgatgaacaccaaacccactcaaataatatttatatttgggttgtttagttgtaaaagtgaagacccaagtttaaagtaccaattggccaatgccattcgattgttttgttcaaagagcacttggtacgtcatttggactcgtatcttagtccaatatattgcattttgcttcaatgtgtagaatccgacaaagtgcatgttctaaaattgtaaatctaactaaattagaaagcttgttactaattt

SEQ ID NO: 99 - DNA, 191 bp, Cauliflower mosaic virus
ctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaatta

SEQ ID NO: 100 - DNA, 250 bp, Agrobacterium tumefaciens
cgttcaaacatttggcaataaagtttcttaagattgaatcctgttgccggtcttgcgatgattatcatatatatttctgttgattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatc

SEQ ID NO: 101 - DNA, 68 bp, Tobacco mosaic virus
gtatttttacaacaattaccaacaacaacaaacaacaaacaacattacaattactatttacataaacc

SEQ ID NO: 102 - DNA, 510 bp, Figwort mosaic virus; identical to SEQ ID NO: 68

SEQ ID NO: 103 - DNA, 493 bp, Unknown
  figwort and cauliflower mosaic virus/synthetic
agctgcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactattgcgtttgacgaacgcagtgacgaccacaaaactcgagacttttcaacaaagggtaatatccggaaacctcctcggattccattgcccagctatctgtcactttattgtgaagatagtggaaaaggaaggtggctcctacaaatgccatcattgcgataaaggaaaggctatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgaacaatcccactatccttc

SEQ ID NO: 104 - DNA, 413 bp, Glycine max
gtatgttatgtatctcactctgctcatctctttcatatgtgtttctgatctttctacctctgggttgtaattaatgctaatagtgtgagagtgcttaattctctatcagtaatgaaaattttgtctgctttaattattttgttcaagtggggtctcaattacaatcaccccttttcaagtttgaatatgcttctagcgtttttgggacttgagttcatatgggggtctcttcctttcttaaattttgtgtttttccttgattcaatcattattgaaaattaagttcaattgggggtctcagtctcagagcatttggcttttgaatcatatgatctttcgataggtgtttaaaaagtaatcgactttcagtttcttgatctgaataatcagtctttcattgtctgcgcatgtag

SEQ ID NO: 105 - DNA, 107 bp, Zea mays
gtaactaaccactgccgccgcccatttcttcttcgaccggttgccgcctgcgcgcggcactgctcgtacgtctccccgccagtgcttactgtaatgcatgcatgcag

SEQ ID NO: 106 - DNA, 110 bp, Mus musculus
gattcgtcagtagggttgtaaaggtttttcttttcctgagaaaacaaccttttgttttctcaggttttgctttttggcctttccctagctttaaaaaaaaaaaagcaaaa

SEQ ID NO: 107 - protein, 1272 aa, Unknown
  Uncultured Clostridium sp. isolate 2789STDY5608795
MEDKQFLERYKEFIGLNSLSKTLRNSLIPVGSTLKHIQEYGILEEDSLRAQKREELKGIMDDYYRNYIEMHLRDVHDIDWNELFEALTEVKKNQTDDAKKCLEKIQEKKRKEIYQYLSDDAVFSEMFKEKMISGILPDFIRCNEEYSEEEKEEKLKTVALFHRFTSSFNDFFLNRKNVFTKEAIATAIGYRVVHENAEIFLENMVAFQNIQKSAESQISIIERKNEHYFMEWKLSHIFTADYYMMLMTQKAIEHYNEMCGVVNQHMKEYCQKEKKNWNLYRMKRLHKQILSNASTSFKIPEKYENDAEVYESVNSFLQNVMEKTVMERIAVLKNNTDNFDLSKIYITAPYYEKISNYLCGSWNTIADCLTHYYEQQIAGKGARKDQKVKAAVKADKWKSLSEIEQLLKEYARAEEVKRKPEEYIAEIENIVSLKEVHLLEYHPEVNLIENEKYATEIKDVLDNYMELFHWMKWFYIEEAVEKEVNFYGELDDLYEEIRDIVPLYNKVRNYVTQKPYSDTKIKLNFGTPTLANGWSKSKEYDYNAILLQKDGKYYMGIFNPVQKPEKEIIEGHSHPLEGNEYKKMVYYYLPSANKMLPKVLLSKKGMEIYQPSEYIINGYKERRHIKSEEKFDLQFCHDLIDYFKSGIERNPDWKVFGFHFSDTDTYQDISGFYREVEDQGYKIDWTYIKEADIDRLNEEGKLYLFQIYNKDFSEKSTGRENLHTMYLKNLFSEENIREQVLKLNGEAEIFFRKSSVKKPIIHKKGTMLVNRTYMEEMHGESVKKNIPEKEYQEIYNYMNHRWKGELSAEAKEYLKKAVCHETKKDIVKDYRYSVDKFFIHLPITINYRASGKEALNSVAQRYIAHQNDMHVIGIDRGERNLIYVSVINMQGEIIEQKSFNVVNKYNYKEKLKEREQNRDEARKNWKEIGQIKDLKEGYLSGVIHEIAKMMIKYHAIVAMEDLNYGFKRGRFKVERQVYQKFENMLIQKLNYLVFKDRSADEDGGVLRGYQLAYIPDSVKKLGRQCGMIFYVPAAFTSKIDPATGFVDIFNHKAYTTDQAKREFILSFDEICYDVERQLFRFTFDYANFATHNVTLARNNWTIYTNGTRTQKEFVNRRVRDKKEVFDPTEKMLKLLELEGVEYQSGANLLPKLEKISDPHLFHELQRIVRFTVQLRNSKNEENDVDYDHVISPVLNEEGKFFDSSKYENKEEKKESLLPVDADANGAYCIALKGLYIMQAIQKNWSEEKALSPDVLRLNNNDWFDYIQNKRYR

SEQ ID NO: 108 - protein, 1247 aa, Unknown
  Uncultured bacterium (gcode 4) ACD_3C00058, whole genome shotgun sequence
MFKGDAFTGLYEVQKTLRFELVPIGLTQSYLENDWVIQKDKEVEENYGKIKAYFDLIHKEFVRQSLENAWLCQLDDFYEKYIELHNSLETRKDKNLAKQFEKVMKSLKKEFVSFFDAKWNEWKQKFSFLKKWWIDVLNEKEVLDLMAEFYPDEKELFDKFDKFFTYFSNFKESRKNFYADDGRAWAIATRAIDENLITFIKNIEDFKKLNSSFREFVNDNFSEEDKQIFEIDFYNNCLLQPWIDKYNKIVWWYSLENWEKVQWLNEKINNFKQNQNKSNSKDLKFPRMKLLYKQILGDKEKKVYIDEIRDDKNLIDLIDNSKRRNQIKIDNANDIINDFINNNAKFELDKIYLTRQSINTISSKYFSSWDYIRWYFWTGELQEFVSFYDLKETFWKIEYETLENIFKDCYVKGINTESQNNIVFETQGIYENFLNIFKFEFNQNISQISLLEWELDKIQNEDIKKNEKQVEVIKNYFDSVMSVYKMTKYFSLEKWKKRVELDTDNNFYNDFNEYLEGFEIWKDYNLVRNYITKKQVNTDKIKLNFDNSQFLTWWDKDKENERLGIILRREWKYYLWILKKWNTLNFGDYLQKEWEIFYEKMNYKQLNNVYRQLPRLLFPLTKKLNELKWDELKKYLSKYIQNFWYNEEIAQIKIEFDIFQESKEKWEKFDIDKLRKLIEYYKKWVLALYSDLYDLEFIKYKNYDDLSIFYSDVEKKMYNLNFTKIDKSLIDGKVKSWELYLFQIYNKDFSESKKEWSTENIHTKYFKLLFNEKNLQNLVVKLSWWADIFFRDKTENLKFKKDKNGQEILDHRRFSQDKIMFHISITLNANCWDKYWFNQYVNEYMNKERDIKIIWIDRWEKHLAYYCVIDKSWKIFNNEIWTLNELNWVNYLEKLEKIESSRKDSRISWWEIENIKELKNGYISQVINKLTELIVKYNAIIVFEDLNIWFKRWRQKIEKQIYQKLELALAKKLNYLTQKDKKDDEILWNLKALQLVPKVNDYQDIWNYKQSWIMFYVRANYTSVTCPNCWLRKNLYISNSATKENQKKSLNSIAIKYNDWKFSFSYEIDDKSWKQKQSLNKKKFIVYSDIERFVYSPLEKLTKVIDVNKKLLELFRDFNLSLDINKQIQEKDLDSVFFKSLTHLFNLILQLRNSDSKDNKDYISCPSCYYHSNNWLQWFEFNWDANWAYNIARKGIILLDRIRKNQEKPDLYVSDIDWDNFVQSNQFPNTIIPIQNIEKQVPLNIKI

SEQ ID NO: 109 - protein, 1298 aa, Unknown
  Thiomicrospira sp. XS5 ZB100000
MTKTFDSEFFNLYSLQKTVRFELKPVGETASFVEDFKNEGLKRVVSEDERRAVDYQKVKEIIDDYHRDFIEESLNYFPEQVSKDALEQAFHLYQKLKAAKVEEREKALKEWEALQKKLREKVVKCFSDSNKARFSRIDKKELIKEDLINWLVAQNREDDIPTVETFNNFTTYFTGFHENRKNIYSKDDHATAISFRLIHENLPKFFDNVISFNKLKEGFPELKFDKVKEDLEVDYDLKHAFEIEYFVNFVTQAGIDQYNYLLGGKTLEDGTKKQGMNEQINLFKQQQTRDKARQIPKLIPLFKQILSERTESQSFIPKQFESDQELFDSLQKLHNNCQDKFTVLQQAILGLAEADLKKVFIKTSDLNALSNTIFGNYSVFSDALNLYKESLKTKKAQEAFEKLPAHSIHDLIQYLEQFNSSLDAEKQQSTDTVLNYFIKTDELYSRFIKSTSEAFTQVQPLFELEALSSKRRPPESEDEGAKGQEGFEQIKRIKAYLDTLMEAVHFAKPLYLVKGRKMIEGLDKDQSFYEAFEMAYQELESLIIPIYNKARSYLSRKPFKADKFKINFDNNTLLSGWDANKETANASILFKKDGLYYLGIMPKGKTFLFDYFVSSEDSEKLKQRRQKTAEEALAQDGESYFEKIRYKLLPGASKMLPKVFFSNKNIGFYNPSDDILRIRNTASHTKNGTPQKGHSKVEFNLNDCHKMIDFFKSSIQKHPEWGSFGFTFSDTSDFEDMSAFYREVENQGYVISFDKIKETYIQSQVEQGNLYLFQIYNKDFSPYSKGKPNLHTLYWKALFEEANLNNVVAKLNGEAEIFFRRHSIKASDKVVHPANQAIDNKNPHTEKTQSTFEYDLVKDKRYTQDKFFFHVPISLNFKAQGVSKFNDKVNGFLKGNPDVNIIGIDRGERHLLYFTVVNQKGEILVQESLNTLMSDKGHVNDYQQKLDKKEQERDAARKSWTTVENIKELKEGYLSHVVHKLAHLIIKYNAIVCLEDLNFGFKRGRFKVEKQVYQKFEKALIDKLNYLVFKEKELGEVGHYLTAYQLTAPFESFKKLGKQSGILFYVPADYTSKIDPTTGFVNFLDLRYQSVEKAKQLLSDFNAIRFNSVQNYFEFEIDYKKLTPKRKVGTQSKWVICTYGDVRYQNRRNQKGHWETEEVNVTEKLKALFASDSKTTTVIDYANDDNLIDVILEQDKASFFKELLWLLKLTMTLRHSKIKSEDDFILSPVKNEQGEFYDSRKAGEVWPKDADANGAYHIALKGLWNLQQINQWEKGKTLNLAIKNQDWFSFIQEKPYQE

SEQ ID NO: 110 - protein, 1318 aa, Unknown
  Flavobacterium branchiophilum FL-15
MTNKFTNQYSLSKTLRFELIPQGKTLEFIQEKGLLSQDKQRAESYQEMKKTIDKFHKYFIDLALSNAKLTHLETYLELYNKSAETKKEQKFKDDLKKVQDNLRKEIVKSFSDGDAKSIFAILDKKELITVELEKWFENNEQKDIYFDEKFKTFTTYFTGFHQNRKNMYSVEPNSTAIAYRLIHENLPKFLENAKAFEKIKQVESLQVNFRELMGEFGDEGLIFVNELEEMFQINYYNDVLSQNGITIYNSIISGFTKNDIKYKGLNEYINNYNQTKDKKDRLPKLKQLYKQILSDRISLSFLPDAFTDGKQVLKAIFDFYKINLLSYTIEGQEESQNLLLLIRQTIENLSSFDTQKIYLKNDTHLTTISQQVFGDFSVFSTALNYWYETKVNPKFETEYSKANEKKREILDKAKAVFTKQDYFSIAFLQEVLSEYILTLDHTSDIVKKHSSNCIADYFKNHFVAKKENETDKTFDFIANITAKYQCIQGILENADQYEDELKQDQKLIDNLKFFLDAILELLHFIKPLHLKSESITEKDTAFYDVFENYYEALSLLTPLYNMVRNYVTQKPYSTEKIKLNFENAQLLNGWDANKEGDYLTTILKKDGNYFLAIMDKKHNKAFQKFPEGKENYEKMVYKLLPGVNKMLPKVFFSNKNIAYFNPSKELLENYKKETHKKGDTFNLEHCHTLIDFFKDSLNKHEDWKYFDFQFSETKSYQDLSGFYREVEHQGYKINFKNIDSEYIDGLVNEGKLFLFQIYSKDFSPFSKGKPNMHTLYWKALFEEQNLQNVIYKLNGQAEIFFRKASIKPKNIILHKKKIKIAKKHFIDKKTKTSEIVPVQTIKNLNMYYQGKISEKELTQDDLRYIDNFSIFNEKNKTIDIIKDKRFTVDKFQFHVPITMNFKATGGSYINQTVLEYLQNNPEVKIIGLDRGERHLVYLTLIDQQGNILKQESLNTITDSKISTPYHKLLDNKENERDLARKNWGTVENIKELKEGYISQVVHKIATLMLEENAIVVMEDLNFGFKRGRFKVEKQIYQKLEKMLIDKLNYLVLKDKQPQELGGLYNALQLTNKFESFQKMGKQSGFLFYVPAWNTSKIDPTTGFVNYFYTKYENVDKAKAFFEKFEAIRFNAEKKYFEFEVKKYSDFNPKAEGTQQAWTICTYGERIETKRQKDQNNKFVSTPINLTEKIEDFLGKNQIVYGDGNCIKSQIASKDDKAFFETLLYWFKMTLQMRNSETRTDIDYLISPVMNDNGTFYNSRDYEKLENPTLPKDADANGAYHIAKKGLMLLNKIDQADLTKKVDLSISNRDWLQFVQKNK

SEQ ID NO: 111 - protein, 1251 aa, Unknown
  Moraxella bovoculi strain 57922
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPKVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 112 - protein, 1285 aa, Unknown
  Candidatus Roizmanbacteria bacterium GW2011_GWA2_37_7 US54_C0016
MKSFDSFTNLYSLSKTLKFEMRPVGNTQKMLDNAGVFEKDKLIQKKYGKTKPYFDRLHREFIEEALTGVELIGLDENFRTLVDWQKDKKNNVAMKAYENSLQRLRTEIGKIFNLKAEDWVKNKYPILGLKNKNTDILFEEAVFGILKARYGEEKDTFIEVEEIDKTGKSKINQISIFDSWKGFTGYFKKFFETRKNFYKNDGTSTAIATRIIDQNLKRFIDNLSIVESVRQKVDLAETEKSFSISLSQFFSIDFYNKCLLQDGIDYYNKIIGGETLKNGEKLIGLNELINQYRQNNKDQKIPFFKLLDKQILSEKILFLDEIKNDTELIEALSQFAKTAEEKTKIVKKLFADFVENNSKYDLAQIYISQEAFNTISNKWTSETETFAKYLFEAMKSGKLAKYEKKDNSYKFPDFIALSQMKSALLSISLEGHFWKEKYYKISKFQEKTNWEQFLAIFLYEFNSLFSDKINTKDGETKQVGYYLFAKDLHNLILSEQIDIPKDSKVTIKDFADSVLTIYQMAKYFAVEKKRAWLAEYELDSFYTQPDTGYLQFYDNAYEDIVQVYNKLRNYLTKKPYSEEKWKLNFENSTLANGWDKNKESDNSAVILQKGGKYYLGLITKGHNKIFDDRFQEKFIVGIEGGKYEKIVYKFFPDQAKMFPKVCFSAKGLEFFRPSEEILRIYNNAEFKKGETYSIDSMQKLIDFYKDCLTKYEGWACYTFRHLKPTEEYQNNIGEFFRDVAEDGYRIDFQGISDQYIHEKNEKGELHLFEIHNKDWNLDKARDGKSKTTQKNLHTLYFESLFSNDNVVQNFPIKLNGQAEIFYRPKTEKDKLESKKDKKGNKVIDHKRYSENKIFFHVPLTLNRTKNDSYRFNAQINNFLANNKDINIIGVDRGEKHLVYYSVITQASDILESGSLNELNGVNYAEKLGKKAENREQARRDWQDVQGIKDLKKGYISQVVRKLADLAIKHNAIIILEDLNMRFKQVRGGIEKSIYQQLEKALIDKLSFLVDKGEKNPEQAGHLLKAYQLSAPFETFQKMGKQTGIIFYTQASYTSKSDPVTGWRPHLYLKYFSAKKAKDDIAKFTKIEFVNDRFELTYDIKDFQQAKEYPNKTVWKVCSNVERFRWDKNLNQNKGGYTHYTNITENIQELFTKYGIDITKDLLTQISTIDEKQNTSFFRDFIFYFNLICQIRNTDDSEIAKKNGKDDFILSPVEPFFDSRKDNGNKLPENGDDNGAYNIARKGIVILNKISQYSEKNENCEKMKWGDLYVSNIDWDNFVTQANARH

SEQ ID NO: 113 - protein, 1207 aa, Unknown
  Pseudobutyrivibrio xylanivorans
MYYQNLTKMYPISKTLRNELIPVGKTLENIRKNGILEADIQRKADYEHVKKLMDNYHKQLINEALQGVHLSDLSDAYDLYFNLSKEKNSVDAFSKCQDKLRKEIVSFLKNHENFPKIGNKEIIKLIQSLNDNDADNNALDSFSNFYTYFSSYNEVRKNLYSDEEKSSTVAYRLINENLPKSLDNIKAYAIAKKAGVRAEGLSEEEQDCLFIIETFERTLTQDGIDNYNADIGKLNTAINLYNQQNKKQEGFRKVPQMKCLYKQILSDREEAFIDEFSDDEDLITNIESFAENMNVFLNSEIITDFKNALVESDGSLVYIKNDVSKTLFSNIVFGSWNAIDEKLSDEYDLANSKKKKDEKYYEKRQKELKKNKSYDLETIIGLFDDSIDVIGKYIEKLESDITAIAEAKNDFDEIVLRKHDKNKSLRKNTNAVEAIKSYLDTVKDFERDIKLINGSGQEVEKNLVVYAEQENILAEIKNVDSLYNMSRNYLTQKPFSTEKFKLNFENPTLLNGWDRNKEKDYLGILFEKEGMYYLGIINNNHRKIFENEKLCTGKESCFNKIVYKQISNAAKYLSSKQINPQNPPKEIAEILLKRKADSSSLSRKETELFIDYLKDDFLVNYPMIINSDGENFFNFHFKQAKDYGSLQEFFKEVEHQAYSLKTRPIDDSYIYRMIDEGKLYLFQIHNKDFSPYSKGNLNLHTIYLQMLFDQRNLNNVVYKLNGEAEVFYRPASINDEEVIIHKAGEEIKNKNSKRAVDKPTSKFGYDIIKDRRYSKDKFMLHIPVTMNFGVDETRRFNDVVNDALRNDEKVRVIGIDRGERNLLYVVVVDTDGTILEQISLNSIINNEYSIETDYHKLLDEKEGDRDRARKNWTTIENIKELKEGYLSQVVNVIAKLVLKYNAIICLEDLNFGFKRGRQKVEKQVYQKFEKMLIDKLNYLVIDKSRKQEKPEEFGGALNALQLTSKFTSFKDMGKQTGIIYYVPAYLTSKIDPTTGFANLFYVKYENVEKAKEFFSRFDSISYNNESGYFEFAFDYKKFTDRACGARSQWTVCTYGERIIKYRNADKNNSFDDKTIVLSEEFKELFSIYGISYEDGAELKNKIMSVDEADFFRCLTGLLQKTLQMRNSSNDGTRDYIISPIMNDRGEFFNSEACDASKPKDADANGAFNIARKGLWVLEQIRNTPSGDKLNLAMSNAEWLEYAQRNQI

SEQ ID NO: 114 - protein, 1247 aa, Unknown
  Prevotella bryantii B14
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNKEHDNTAIILRKNGLYYLAIMKKSANKIFDKDKLDNSGDCYEKMVYKLLPGANKMLPKVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 115 - protein, 1064 aa, Unknown
  Smithella sp. SCADC
MEKYKITKTIRFKLLPDKIQDISRQVAVLQNSTNAEKKNNLLRLVQRGQELPKLLNEYIRYSDNHKLKSNVTVHFRWLRLFTKDLFYNWKKDNTEKKIKISDVVYLSHVFEAFLKEWESTIERVNADCNKPEESKTRDAEIALSIRKLGIKHQLPFIKGFVDNSNDKNSEDTKSKLTALLSEFEAVLKICEQNYLPSQSSGIAIAKASFNYYTINKKQKDFEAEIVALKKQLHARYGNKKYDQLLRELNLIPLKELPLKELPLIEFYSEIKKRKSTKKSEFLEAVSNGLVFDDLKSKFPLFQTESNKYDEYLKLSNKITQKSTAKSLLSKDSPEAQKLQTEITKLKKNRGEYFKKAFGKYVQLCELYKEIAGKRGKLKGQIKGIENERIDSQRLQYWALVLEDNLKHSLILIPKEKTNELYRKVWGAKDDGASSSSSSTLYYFESMTYRALRKLCFGINGNTFLPEIQKELPQYNQKEFGEFCFHKSNDDKEIDEPKLISFYQSVLKTDFVKNTLALPQSVFNEVAIQSFETRQDFQIALEKCCYAKKQIISESLKKEILENYNTQIFKITSLDLQRSEQKNLKGHTRIWNRFWTKQNEEINYNLRLNPEIAIVWRKAKKTRIEKYGERSVLYEPEKRNRYLHEQYTLCTTVTDNALNNEITFAFEDTKKKGTEIVKYNEKINQTLKKEFNKNQLWFYGIDAGEIELATLALMNKDKEPQLFTVYELKKLDFFKHGYIYNKERELVIREKPYKAIQNLSYFLNEELYEKTFRDGKFNETYNELFKEKHVSAIDLTTAKVINGKIILNGDMITFLNLRILHAQRKIYEELIENPHAELKEKDYKLYFEIEGKDKDIYISRLDFEYIKPYQEISNYLFAYFASQQINEAREEEQINQTKRALAGNMIGVIYYLYQKYRGIISIEDLKQTKVESDRNKFEGNIERPLEWALYRKFQQEGYVPPISELIKLRELEKFPLKDVKQPKYENIQQFGIIKFVSPEETSTTCPKCLRRFKDYDKNKQEGFCKCQCGFDTRNDLKGFEGLNDPDKVAAFNIAKRGFEDLQKYK

SEQ ID NO: 116 - protein, 1251 aa, Unknown
  Bacteroidetes bacterium GWF2_33_38
MNHMKQFTNQFSLSKTLRFELIPQGKTKEFIEINGLIEKDNERAVSYKKVKKIIDEYHKYFIEMVLCDFKLHGLETYETIFNKKEKDDTDKKEFDNIRNSLRKQIADAFAKNPNDEIKERFKNLFAKELIKQDLLNFVDDEQKELVNEFKDFTTYFTGFHQNRRNMYVADEKATAIAYRLVNENLPKFIDNLKIYEKIKKDAPELISDLNKTLVEMEEIVQGKTLDEIFSLSFFNQTLTQTGIELYNIVIGGRTADEGKTKIKGLNEYINTDYNQKQTDKKKKQAKFKQLYKQILSDRHSVSFVAETFETDAQLLENIEQFYSSVLCNYEDDGHTTNIFEAIKNLIIGLKTFDLSKIYLRNDTSLTDISQKLFGDWSIISSALNDYYEKQNPISSKEKQEKYDERKAKWLKQDFNIETIQTALNECDSEIIKEKNNKNIVSEYFAKLGLDKDNKIDLLQKIHHNYVVIKDLLNEPYPENIKLGNQKEQVSQIKDFLDSILNLIHFLKPLSLKDKDKEKDELFYSLFTALFEHLSQTISIYNKVRNYLTQKAYSTEKIKLNFENSTLLNGWDVNKEPVNTSVIFRKNGLFYLGIMSKSNNRIFERNVPVCKNEETAFEKMNYKLLPGANKMLPKVFLSAKGIESFQPSAEIQSKYQKETHKKGDAFVRKDMENLIDFFKQSIAKHTDWKHFNHQFSKTETYNDLSEFYKEVEKQGYKLTFTKLDETYINQLVDEGKLYLFQIYNKDFSPFSKGKPNMHTLYWKMLFDEQNLQNVVYKLNGEAEVFFRQSSIKQTDRIIHKANQAIDNKNPLNNKKQSSFNYDLIKDKRFTLDKFQFHVPITLNFKAEGNEYLNTKVNEYLKSNSDVKIIGLDRGERHLIYLTLINQKGELLKQQSLNVIATSQEHETDYKNLLVNKENERANARQDWKTIETIKELKEGYLSQVVHQIATMMVDENAIVVMEDLNAGFMRGRQKVERQVYQKLEKMLIEKLNYLVFKNNDVNETAGVLNALQLTNKFESFEKMGKQSGFLFYVPAWNTSKIDPATGFVDFLKPKYESVEKAKLFFEKFESIKFNADKNYFEFEFDYKKFTEKAEGSQTKWTVCTHSDVRYRYNPQTKASDEVNVTNELKLIFDKFKIEYKNGKNLKTELLLQDDKQLFSKLLHYLALTLMLRQSKSGTDIDFILSPVAKNGVFYDSRNAMPNLPKDADANGAFHIALKGLWCVQQIKKADDLKKIKLAISNKEWLSFVQNLK

SEQ ID NO: 117 - protein, 1353 aa, Unknown
  Candidatus Peribacteria bacterium RIFCSPLOWO2
MANDIYAQFTRKYALSKTLRFELKPVGKTLDNMRKHLEYDPELRTFLKDQCIEDAYQALKPKVDELHQRFINLALGSARAKSMEFSPFFEIRRQLLELKMKAKEKGVGDKDIQNLEGELDGAGETLRKAFGDIFKDAGARWKELYGAYGWKKGGKETKGSAVLSCPDVLKVIDEENEKKELPEQCVRDAIKALEGFFTYLGGFNQNRENYYETAKEAATAIATRIVHENLPRFTDNALTFESGNKEYLDAYRFLKDAGKVIQRKDEKPVTPISEAIFCQNYFGNCLTQEEIERYNEEIGNCNLVINLYNQTEDEEGFRRLPIFKVLYKQIGCGKKDALFFRLTHEKKEDADAARRENPNKQFDSVEEILERARTAGEKYFQPNKTADMDTLSEFIRYLKERKDYSGFYWSKNALNTISNKYFANWHALKDRLKETGVFKKGGKDDEEYVKIPDAIELQPFFELLDVTKDWRKTLFKLSQRNGSEEIEKMRIIDNAKTPHEALLGMLTLDVADRAEKFVNGAAGVMRVTREYFANADKMKEERRRVWKEEIKQWMDHALAVNRMLKYFKVRESKVKGAPIDATLTKALGILLYGKDGDAEWFKWYDTLRNFLTKKPQDDAKENKLKLNFENGSLLGGWSDGQEKNKAAVLLRKDGLYYLGILKKKSLFDTKQENNPMYEHFTQGCERLILTNLKFQTLAGKGFSRKFRIAYGAMGKQDPQKAIISLQDIMKERYLNKYPLLSPIASASYTDKKKFDKEVQEALKESYDCKFRKINWNEIEQYTKSGDMYLFQIHSKDFAPGASGKKDLQTIYWQSLFDSNGSHQLNGGGEIFYRKQALRDKHVKKGYEQKPWIIESRRFTLESGKFMFHCPIKLNYKSSAQSDPKYAFPFVNKYINEHFAGNADICFLGIDRGEKHLAYYSLVDSRGTIVDQGTLNIPFTDSKGNPRTVRAIKRTLDKNGHEWVEEVECSNYNDLLAARAGDRDYARKNWQTIGTIKELKEGYISQVIHKIVRLAALDSDKPMFIVLEDLSIGFMRGRQKIEKSVYKQFEVALAKKLSFLVDKSKDGKYGEVGSVTAALQLTPPIKNFDELKERGKQAGVMLFVRPDYTSQTDPVTGWRKRIYIDSGSELTIRKKVTESFEDIAFDGKDYVFVYKDVVTGKCWSMYSGKDGESLKRFHRVRSVDKDEWKSEPQNLAEMLDCLFKDFDKDRSLLSQIVDEGMQPKKVNEHSAWESFRFVIKLIQQIRNTDGGDGGRESDFLLSPVREHGNHFDSRPYWDEEQRTGHPALLPSCGDANGAYNIARKGIILHEHMKRDFKLYVRDEEWDSWLAGKETWDNWLRNHEKDLRKTPRKGG

SEQ ID NO: 118 - protein, 1289 aa, Unknown
  Nitrospinae bacterium RIFCSPLOWO2
MENKELFNSFTKKCQLSKTLRFELVPQGETEKFIKKKGLLKQDKDRADDYRKAKKLIDEYHKDFIEHALSGKQLKKLQAYYDEFTALLGKPAKERDTRVLSNISEALRKEIAGWLKDNPIKDEKKLIKEIVPNFLKSKDRNDDAALVLKFKGFTTYFGGFNENRRNMYSAEEKSTAIAYRIVHENLPKFISNMKTFQRLTENHKIDFLEVETQMNDELDGNKLKDVFSIDYFNQCLTQSGIDRYNTILGGKTDSRGAQIQGVNIKINLFGQKNNLKSKDAPVLARLYKQILSDRTSASFLPEKFETAKELIASIREFYEKAINGFIKNNERKNVIDEIESLFNKKLNPTDCDLSQIYIRNIFISAVSQQIFGSYSVITSALNAFIDKTYKTKKEKEKQQKKSYFGIAEIEAALKAYLQETEIENKEKREEVLKHANPVLQYLNSLTTNIEINNKKEKANVIVRFRQQHEAVQSVLNKEYGNNSELIQDKNAVAAIKDYLDSCQHILHFVKPLFVVPPKKENAELPDKDAFYSEFDELFEQLKSVTPLYNMVRNFLTQKPYSTEKIKLNFENVSLLSGWDVNKETDNTSVIFRKDSLYYLGIMDKKHNKVFHDIPASSDNDFYEKMNYKLLPGANKMLPKVIFSDRWIEYFNPSKELIEKYKKGTHKKGEIFSLSDCHALIDFFKTSIAKHEDWKQFNFQFSPTKTYQDINEFYREVEHQGYKISFQNVSAKYIHQLVSEGKLFLFKIYNKDFSPYSKGKPNLHTLYWKAVFDKENLKDVVVKLNGEAEVFYRPQSIPKKSKIVHKKNKPIVNKNPNNPKKQSLFKEYDIVKDKRYTEDKYHFHVPITLNFKEAKVPSENDRKKAFAYTFNKGANETLKENFPNIIGIDRGERHLAYYSLINSKGEILEQGSFNVIKNEFNGTKHETDYYASLVEKEKARDAARKSWDTIGKIKELKEGYLSQVVHKIARMMIEHNAIIVLEDLTMKFKDIRKKVERQVYQKLEKMLIDKLNYLVFKDREAYEPGGVLNAYQLAAPFTSFKDMGKQTGFIFYVPAANTSKIDYATGFMNFIYPKIEDAVEFFQKFEYIRFNPDKNYFEFAARYNNFVKDDEAKLPDEYNEPWIICTHGEQRFQYQPSYKSFKEVNVTQELQDLFSKHAIMPYAHGNDLSPQIKDKGNTSFYKGLIALLRLVLQMRYTDGKGRDFILSPVANDEGVFFNSEKAKETEPNDADANGAYHIALKGLLLLKRIKGEFKKEEKTGKKKTQKENWIDLSISNKEWYEFAQKKEYRK

SEQ ID NO: 119 - protein, 1342 aa, Unknown
  Candidatus Ryanbacteria bacterium RIFCSPHIGHO2
MANEKKEKSIFDEFTGKYSLSKTLKFELRPVGKTLENMRQHLGYDKNLQTFLADQKIEDAYQSLKPIFDFLHEKFITESLESDVARKIDFTEYFEKYKRRKDLSEKDFVGVEKSLRDEFLKAYDETAESLRIKAGKNEKGKFILSENGHKILTEHGILEYIKKNIDEFVEITPEREIEKSLAAFEGFFTYFGGFNQNRENYYETKKETATSVATRVIHENLPKFCDNILAFDGRSRDYKNAYSILQKLGRTLVDKEGKELIPIEENIFKIEYFNSCMSQRGVEKYNDQIGNANFLINLYNQAKKEENGFKKLPLLKTLYKQIGCGEKRSLFFAINYDQADECKKQENNTEIRSLEEVLNLANKAGKKYFKGKSDDGMINTLPEFLEYLKNRENYLGVYWSKTALNTISSKYFTNWHTLKERLKEAKVFKKAGKDSEEEIMIPEAVELEGFFSVLDVVENWKDEGVLFKQNLTEAQKGAQGEDKNKARKDIILNASIPSEALLNLIFLGIEQHAKAFLDRAPEVLALKEYKNATSKEVIKSWMDHALSITQMLKYFLVKESKVKGTALDSTISQALEVFLQSDDADWFGWYDALRNYLTKKPQDDLKENKLKLNFENSTLASGWDVSKEPDNYCVIFQNPEGEKFLAIIARKKDRKGFNKIFEKNNHNRLYTVSGNKNWKKIEYKLLPGPNKMLPKCLMPKSDRFKYGATQEILDIYDEGSFKKNEVSFSIQKLYKMIDFYKMALERYKDWGCFNFSFQETSKYQDISQFYNDVEKQGYKLDVVDINKSIVDSLVEDGSIYLFEIKNQDSNQGKKENHRDNLHTIYWRAVFESVENRPKLNGGAEIFYRKALLPEKLERNEDRKGKKIIKNPRFSKEKFLFHVPITLNFSSKNTRINDLVNDILSRYGDVHFLGIDRGEKHLAYYSLVDQNGRIKDHGTLNIPFLDKDGNSRMVRAKKRTLGKDGKEQIEMVECKDYNELLDARAGDRDYARKNWQTIGTIKDLKDGYISQVVRTIADLALANNAFIVLESLDTGFKRGRQKIEKSVYQKLELALAKKLNFLVDKKAKFGEIGSVTNALQLTPPVANYGDIENRKQLGVMLYVKADYTSQTDPITGWRKSIYLKKGSEEYIRSQIRDGFSDISFDGKDYVFTYEDKNTHKQWKLYSGKNGKSLDRYHREKGETRNSWDPIRKDVTEMLNGIFENFNRSNSIHSQIVDEGVELKKIDSAHTAWESLRFTIDLIQQIRNTGTAKEDDDFILSPVRDENGNHFDSRKTIKYQPNSGDANGAYNIARKGIVLNEHIKRGYRLFISDEEWDAWLAGKERWEKWISDHKKDLAKKQTAQ

SEQ ID NO: 120 - protein, 1390 aa, Unknown
  Candidatus Wildermuthbacteria bacterium RIFCSPHIGHO2
MIDNTKEKKEGSVFDGFTRKYQLSKTLRFELRPILNTPKMLDDEQVIKNDETRRKKYEAVKPWFDQLHREFIEDALKSFKFKNLAIYQDTFQTWQKDRKSKQKKDTLVKIEVGLREEIVRRFEEVANIWVRSEQYKLLGIKKEGLGMLFEAGVFRLLKERFKNEKDTTVDGNNIFDEWTRWTGYFKKFFETRKNFYKSDDTSTAIAYRVINQNLRRFCENIQIFEKISEKIEFSEVEKSFDISCAGIFSLAYYNACLLQGGIDTYNKIIGGEVDEKDKKIPGINELINKYRQDNSGEKIPFLKQLDKQIHSAKEAFIESIETNKELVGKLKTFYENAEVKIQSFRNLIADIVTDYSGYDIDKIYLTKEAVSHNASRWFASFESFERDLFAVVAEKQNKLVYELLRTHKNDSKISDKDGKFSFPDFIKCSHIKRALEKQEGRIWKGEYYEDIVDFEKIKDVFTQFLCVFKFELEQQFFRKTTSAQTGEQTKIGYEIFVTKINELITRENPVIDLEEKIAIKNFADATLLIYQIAKYFAVEKRRGWLDNYDLDDRFYKSSDIGYLNFYRDAFEQIVRPYNLFRNYLTKKPYNTNKWVLSFENPTLADGWDKNKEKTNAAVILRKDGRYYLGIIKEDCKSLFADRYSKEMSEGIESGSFQKMAYKFFPEASKMIPKCSTQTKNVKEHFRKSSSDYNLFHEKDYKISVAITKNIYELNNVFYRKDNIEESFVPKNDFEKKLGVKKFQRQYLEISRDNNGYKQALAQWIEFCIRFLKAYKSTTIFDYSRLREAKEYESLDAFYQDINALTYNISFVPISEQYIKEKNDNGELFLFEIYNKDWSLGPMDKNRKRTKNLHTLYFEQLFSKENEQENFLFQLNGEAELFFRPKTEEKRLGYKVWDAGEKKWVKAKEKEDGAVIDRKRYAKDIILFHCPITLNRVSESKTKREMDVEIREVLSSTPGVHIIGVDRGEKHLAYYSVIDQNGKIIETDTLNSIGKDGRGKPVEYASKLEKRAQEREASRRDWEEVEAIKDLKKGYISQVIRNLADLIIKHNAIIVFEDLNMRFKQIRGGIEKSAYQQLERALIDKLSFLVKKGEEDPKQTGHILRAYQLAAPVIAFKDMGKQTGLIFYTQAGYTSKTCPECGYRRNIKCLFENIEQAKTLIENLESINYNKKEDVFQISYSLEKLSSKDQKKEKKVSNELYAKTLKKDIFILTTKNALRYKWYDRYSEKAKVAKRGIDEYKGEVNESETKKGVVKEFNLTEYLKGLLKTYEIDYEHGGIREQILSVARGREFYKDFLYALFLLTETRHSISGRNTDYIQCPECEFDSRKGFKDIKEFNGDANGAYNIARKGIMILEKIKQFKKDNDGNLEKMGWGDLSISIEEWDKFTQKE

SEQ ID NO: 121 - protein, 1265 aa, Unknown
  Firmicutes bacterium CAG_194_44_15
MERKDFINYDQVSKTIRNGLIPTEYTLKNIEETGVLVSDEYRAEVRNVLKKIMDDYYKEYINMCLNREIKMDWRPLFDAYELVKKGKMKPKEIENIQDEKRKEIYDILSAHDEFKKMFSAKMITELLPQFISQSTGYNEDEKKQYEEVIHIYSRFTSDFTDFFQNRKNVFSSAGIATSICNRIVNENAEIFSDNKSTFDRIKKDISYIDEIIDSDLKTYLDGWELEQIYSVDFYSRLMSQSGIDFYNMISGAVNKAVNEYCQKNGLNKNKYLLRKLRKQILSNSESTFQIPEKFLADEEVYKAVGQFIDNIKSKNVIEILKDIGSNCENYDLRRIYIAESAYEDVSIFMGYGWNGIKGCLEKKYEKEIAPGKAKDIKIKKLISQEKERSIGEIDELFHIYGEEKDGKAAIQYIEEVVELCNEVPTRLVYDSSEKLTENDNKAAEIKNVLDYYFKIFHWIKTFITDDILDKDIVFYSGIEFAYEEIKDIVPLYNKVRNYVTQKPYSSEKIKLKFGTPTLANGWSKSKEFDNNAILLVRDNKYYLGIFNVLNKPDKKIMAGYANKKNSSDYAKMVYNLLPGPSKMLPKVCLSQKGKDTYHPSAYIVDNYERKAHVKSSEHFSIQYCHDLIDYFKECIKRNDDWKCFDFKFSDTEQYNDISEFYKEVELQGYSIGWTYISGEDIEALDKEGKLYLFQIYNKDFSEQSHGTDNLHTMYLKNLFSPENLNNIVLKLNGEAELFYRKSSIKKPVVHKKGSILVNKTYTEKTGNGEEVRRPVPDDVYLELVNYYNGEQKAILSDEAKKYMKVVEHHEAVKDITKDYRYTVNKFFIHLPITINFKAEHTGNLNEMVIQYIAKQENMHVIGIDRGERNLIYVSVIDMNGKIKEQKSFNIVNSYNYQEKLRGREKDRLNARKNWKQIANIKEMKEGYLSLVIHEITEMMMKYNAIIAMEDLNYGFKRGRFKVERQVYQKFETMLISKLNYLVDKHKKVDEPGGLLRGYQFAYVPASLDRLGRQCGFIFYVPAAYTSKIDPTTGFVDLFNHSELIKAGKRRDNLSKFDGIYYDEQKDMFCYAFDYKNFVTHNTDIYQNSWEIYTNKERLRKIFGNGRPTGKTEKIELTQMMKEVLTGAGVEYKDGHNLIDDILNSNDNCIKQVLDIFLYSIQLRNSKGENEDSKESDYDRIISPVLNQENEFFDSVVYADKYKKDEKLADKPIDADANGAYCIALKGLYEILQIKNNWKEGEVFSRDTLKITNADWLRFMQSRGFE

SEQ ID NO: 122 - protein, 1322 aa, Unknown
  Candidatus Gottesmanbacteria bacterium CG1_02_37_22
MTGIFKDFTHLYELQKTLRFELIPVGRTKELLEKNHVFEKDEKIAENYKDVKKYFDRLHKEFIKDAFSHTNLPENLLEGYEQKYFSHKLNPSRASRIDLEKIAKRLRTILLKSFNTEADQWKNRYLKNIEQTLKNKNEKQQKKELEKKLKKIKEGTKGIELFFKVEVFDFLKYKYPEAQINGKSIFDPFNKFGCYFKKFHETRINFYKDDGTSTAIPTRIINDNLSIFLENKKIFESKYSKKHKSVFAKNELRIFVLFYFNNCFSQKQIDGYNNTIALINSNVNQLRQNNPEVSKKDLPFFKRLFKQILSQPSKQEIEQDSFIEIFQDEDVFPTMQKFINENKICIPKAKSIFKKFISSQKVKSDEYNISQIYVAKRFINTISNKWFSNWNTIRNLLIPKDKKNIPDFISVTSLKAALQKTQNIVEVNDLFRKEYRDILEEGSDFYQIFLKIWEKEFEKATDIYLNETKEIEKMITEDKKYLPNKKGRLKSGKKGSIQKEKFLDYTQSVFDIYLMMKYFSLEKGKERVWNPEALDEDAIGGFYEKFKEYYENINTWKYFNVFRNYLTKKPYNSEKIKLNFECSSLLSGWSKNYDSYGALIFEKNEKYYLGIINGTKFTKDEIEQLYLDIRNNNISLRLVYNYQKPDFKNFPKLFIRSSGSNFAPAVKKYNLPIDSVLNIYDKGLFKTSNKSSQNYHESLKKIIDYFKLGISQHESYKGFSFKWQETSEYDNISDFYKDATRSCYKVTWENINFSKLYELIESGRLYLFQIYNKDFELDENIAPKGYNFKDKNGRRNLHSIYWKALFSNTNFKKTILKLNGGAELFYRKLTKNLTKDPIITVKNQIKIIKKNNNIFHKKRFTQNKIYFHCPVSINFTENDWKINTKICNTIRNNSKVKIIGIDRGEKNLAYYSVIDHQGNILETDSFNEVQEREDREPTDYQKKLDQIQKERDWQRKSWQEISSIKEMKKGYISQVVHQICKLIRKYEAIVVFEDLNIGFKRGRFAIEKQIYQNLELALAKKLNYMVFKDAKEEETGHFLQAYQLTPPVINFQDIGKQCGIIFYVPASYTSAICPACGFRKNISTSVEKIEKNIDLINKFNIVYDPDKDRFCFRYKRSDFIKSEKEKEDDSKVKLYSNTKLPDDFTFYSNVERFKYIRDQNNRGGKVELKYPNDSLKKLFHENGINFQNFSNISQLIKTRNFENENFYKPFIYIISLILQLRNTTIEINQNENNEKYRDFISCPHCYFHSENNLITLTKRYKGKKPFEFNGDANGAYNIARKGILILQKINKAKRLEEIEYGGLTVTQQEYDKYLALVSSKKA

SEQ ID NO: 123 - protein, 1329 aa, Unknown
  Candidatus Gracilibacteria bacterium CG1_02_38_174
MSNNFQEFTQKYALSKTLRFELKPVGKTKEILEKEMPMYQIINADKNIKAKYIQTKPFFDQLHRDFIKEAFENVELSGLSDFFENWKIYKQDKKANEKIYKKSAENLRKEVVSFLNAKGKDWAEKYHSSGLKKADIEILFEEGIFKVLEIRYGTDTNSFITNATTGEITSIFQGWKGFTGYFLKFWNTRENYYKTDGTSTAIATRIVDQNLPRYLENLEIFEKMKGKIDFESVRGDFSDFEKIGTVEYYSTCLLQEGIDGYNRIIGGYTYENGEKIKGINEIINLYRQTHKDEKVPFLKTLDKQIGSEKIAFMETIDTPEEFRKIFEEFVLKSSEKVVLLKQCLNHLFENELTDGVFLSKESLNTISHKWIDIGNMKLFHESLFTILKKEGAKYDSKEDEYKFPDFIRISDIKTALVKITTESFFWKNRYLYEKDENPTGFLTSDNSLWEGFIQIFSHEFSSLFERTEKDEEGKDIQWGYDISLLNIQKLLENNEYNPNDEKNKIIIKSFADDILRIYQMGKYFALEKKRQWNPDNLEIGEFYSHPEIGYDKFYFDSYKIIVQGYNDIRNYLTKNPWSEEKWKLNFENPTLANGWDKNKETDNSCIFLKRDNKFFLALMSRGNNQVFDERNIQKFAQNIEQGKYEKMVYKYMKDVALGIPKATTQLNAVQEHFFQSDKDYIITKGGSSIGEFIKPLRVTKRIFELNNRIYPKDNLGISFLRNQVNEKEQKNYIKIFQKEFITLGGDEVVYKKAVHDWIDFCKEYTKSYPSCAYFDYSGLKDTKEYSSIDEFYNDLDSFGYQISWQDISSSYIDELVESGKLYLFEIYNQDFSNGKTGAKNLHTLYFEHIFSKENQEVNFPLKLNGQAELFFRPKSIEAKGENRKFNREIIAKKRYTEDKIFFHVPLTLNRTEGDIYGFNTEINNFLAHNPDINIIGIDRGEKHLAYYSVIDQKGNIIESDSLNTVNEINYGEKLTDTAEKRKQARQDWQAVEGIKNLKKGYISAVVHKLTDLIIKYNAIVIFEDLNMRFKQIRGGIEKSVYQQLEKALIEKLNYLVEKGEINPEKAGHLLNAYQLTAPFETFKDMGKQTGIVFYTQAAYTSKIDPVTGWRPHLYLKYSSAEQVKKEIAKFSNIIWNNTEKRFDFMYDIRNFSTQKEYPKNNIWTVCSSVERYRWDKTLNQNKGDYVHYKSITPEFEKLFSDFQIDGTKNILEQINRMETKGNEKFFKSFIFFFGLICQIRNTNKADSDENKQDFILSPVVPFFDSRDSENTKNGLPRNGDENGAYNIARKGLIILQKINEFSDENGNCDKLGWKELSISQVDWDNYIKT

SEQ ID NO: 124 - protein, 1231 aa, Unknown
  Butyrivibrio fibrisolvens MD2001
MYYESLTKLYPIKKTIRNELVPIGKTLENIKKNNILEADEDRKIAYIRVKAIMDDYHKRLINEALSGFALIDLDKAANLYLSRSKSADDIESFSRFQDKLRKAIAKRLREHENFGKIGNKDIIPLLQKLSENEDDYNALESFKNFYTYFESYNDVRLNLYSDKEKSSTVAYRLINENLPRFLDNIRAYDAVQKAGITSEELSSEAQDGLFLVNTFNNVLIQDGINTYNEDIGKLNVAINLYNQKNASVQGFRKVPKMKVLYKQILSDREESFIDEFESDTELLDSLESHYANLAKYFGSNKVQLLFTALRESKGVNVYVKNDIAKTSFSNVVFGSWSRIDELINGEYDDNNNRKKDEKYYDKRQKELKKNKSYTIEKIITLSTEDVDVIGKYIEKLESDIDDIRFKGKNFYEAVLCGHDRSKKLSKNKGAVEAIKGYLDSVKDFERDLKLINGSGQELEKNLVVYGEQEAVLSELSGIDSLYNMTRNYLTKKPFSTEKIKLNFNKPTFLDGWDYGNEEAYLGFFMIKEGNYFLAVMDANWNKEFRNIPSVDKSDCYKKVIYKQISSPEKSIQNLMVIDGKTVKKNGRKEKEGIHSGENLILEELKNTYLPKKINDIRKRRSYLNGDTFSKKDLTEFIGYYKQRVIEYYNGYSFYFKSDDDYASFKEFQEDVGRQAYQISYVDVPVSFVDDLINSGKLYLFRVYNKDFSEYSKGRLNLHTLYFKMLFDERNLKNVVYKLNGQAEVFYRPSSIKKEELIVHRAGEEIKNKNPKRAAQKPTRRLDYDIVKDRRYSQDKFMLHTSIIMNFGAEENVSFNDIVNGVLRNEDKVNVIGIDRGERNLLYVVVIDPEGKILEQRSLNCITDSNLDIETDYHRLLDEKESDRKIARRDWTTIENIKELKAGYLSQVVHIVAELVLKYNAIICLEDLNFGFKRGRQKVEKQVYQKFEKMLIDKLNYLVMDKSREQLSPEKISGALNALQLTPDFKSFKVLGKQTGIIYYVPAYLTSKIDPMTGFANLFYVKYENVDKAKEFFSKFDSIKYNKDGKNWNTKGYFEFAFDYKKFTDRAYGRVSEWTVCTVGERIIKFKNKEKNNSYDDKVIDLTNSLKELFDSYKVTYESEVDLKDAILAIDDPAFYRDLTRRLQQTLQMRNSSCDGSRDYIISPVKNSKGEFFCSDNNDDTTPNDADANGAFNIARKGLWVLNEIRNSEEGSKINLAMSNAQWLEYAQDNTI

SEQ ID NO: 125 - protein, 999 aa, Unknown
  Sneathia amnii strain SN35
MNLLINEVNQKYKSKLNVFNSLYKQILTEEDTKSFVDEILLTPESVIKTIDNFIDSIIMNDIEGLKEEFLKISLENFEGIYISNKKLNEISNRKFGDYNSINMMIKQSMNEKGILSKKEINELIPDLENINKPKVKSFNLSFIFENLTKEHKELIIDYIRENICNVIENVKITIEKYRNIDNKIEFKNNAEKVSKIKEMLESINELCKLIKEFNTDEIEKNNEFYNILNKNFEIFESSYKVLNKVRNFVTKKEVIENKMKLNFSNYQLGNGWHKNKEKDCSIILFRKRNNERWIYYLGILKHGTKIKENDYLSSVDTGFYKMDYYAQNSLSKMIPKCSITVKNVKNAPEDESVILNDSKKFNEPLEITPEIRKLYGNNEHIKGDKFKKESLVKWIDFCKEFLLKYKSFEKAKKEILKLKESNLYENLEEFYSDAEEKAYFLEFINIDEDKIKKLVKEKNLYLFQIYNKDFSAYSTGNKNLHTMYFEELFTDENLKKPVFKLNGNTEVFYRIASSKPKIVHNKGEKLVNKTYLDDGIIKTIPDSVYEEISEKVKNNEDYSKLLEENNIKNLEIKVATHEIVKDKRYFENKFLFYLPITLNKKVSNKNTNKNINKNVIDEIKDCNEYNVIGIDRGERNLISLCIINQNGEIILQKEMNIIQSSDKYNVDYNEKLEIKSKERDNAKKNWSEIGKIKDLKSGYLSAVVHEIVKLAIEYNAVIILEDLNNGFKNSRKKVDKQIYQKFERALIEKLQFLIFKNYDKNEKGGLRNAFQLTPELKNITKVASQQGIIIYTNPAYTSKIDPTTGYANIIKKSNNNEESIVKAIDKISYDKEKDMFYFDINLSNSSFNLTVKNVLKKEWRIYTNGERIIYKDRKYITLNITQEMKDILSKCGIDYLNIDNLKQDILKNKLHKKVYYIFELANKMRNENKDVDYIISPVLNKDGKFFMTQEINELTPKDADLNGAYNIALKGKLMIDNLNKKEKFVFLSNEDWLNFIQGR

SEQ ID NO: 126 - protein, 1287 aa, Unknown
  Coprococcus eutactus strain 2789STDY5608843
MNNNTNNSFEPFIGGNSVSKTLRNELRVGSEYTGKHIKECAIIAEDAVKAENQYIVKEMMDDFYRDFINRKLDALQGINWEQLFDIMKKAKLDKSNKVSKELDKIQESTRKEIVKIFSSDPIYKDMLKADMISKILPEYIVDKYGDAASRIEAVKVFYGFSGYFIDFWASRKNVFSDKNIASAIPHRIVNVNARIHLDNITAFNRIAEIAGDEVAGIAEDACAYLQNMSLEDVFTGACYGEFICQKDIDRYNNICGVINQHMNQYCQNKKISRSKFKMERLHKQILCRSESGFEIPIGFQTDGEVIDAINSFSTILEEKDILDRLRTLSQEVTGYDMERIYVSSKAFESVSKYIDHKWDVIASSMYNYFSGAVRGKDDKKDAKIQTEIKKIKSCSLLDLKKLVDMYYKMDGMCLEHEATEYVAGITEILVDFNYKTFDMDDSVKMIQNEHMINEIKEYLDTYMSIYHWAKDFMIDELVDRDMEFYSELDEIYYDLSDIVPLYNKVRNYVTQKPYSQDKIKLNFGSPTLANGWSKSKEFDNNVVVLLRDEKIYLAILNVGNKPSKDIMAGEDRRRSDTDYKKMNYYLLPGASKTLPHVFISSNAWKKSHGIPDEIMYGYNQNKHLKSSPNFDLEFCRKLIDYYKECIDSYPNYQIFNFKFAATETYNDISEFYKDVERQGYKIEWSYISEDDINQMDRDGQIYLFQIYNKDFAPNSKGMQNLHTLYLKNIFSEENLSDVVIKLNGEAELFFRKSSIQHKRGHKKGSVLVNKTYKTTEKTENGQGEIEVIESVPDQCYLELVKYWSEGGVGQLSEEASKYKDKVSHYAATMDIVKDRRYTEDKFFIHMPITINFKADNRNNVNEKVLKFIAENDDLHVIGIDRGERNLLYVSVIDSRGRIVEQKSFNIVENYESSKNVIRRHDYKGKLVNKEHYRNEARKSWKEIGKIKEIKEGYLSQVIHEISKLVLKYNAIIVMEDLNYGFKRGRFKVERQVYQKFETMLINKLAYLVDKSRAVDEPGGLLKGYQLTYVPDNLGELGSQCGIIFYVPAAYTSKIDPVTGFVDVFDFKAYSNAEARLDFINKLDCIRYDASRNKFEIAFDYGNFRTHHTTLAKTSWTIFIHGDRIKKERGSYGWKDEIIDIEARIRKLFEDTDIEYADGHNLIGDINELESPIQKKFVGELFDIIRFTVQLRNSKSEKYDGTEKEYDKIISPVMDEEGVFFTTDSYIRADGTELPKDADANGAYCIALKGLYDVLAVKKYWKEGEKFDRKLLAITNYNWFDFIQNRRF

SEQ ID NO: 127 - protein, 1305 aa, Unknown
  Lachnospira pectinoschiza strain 2789STDY5834886
MNKAADNYTGGNYDEFIALSKVQKTLRNELKPTPFTAEHIKQRGIISEDEYRAQQSLELKKIADEYYRNYITHKLNDINNLDFYNLFDAIEEKYKKNDKDNRDKLDLVEKSKRGEIAKMLSADDNFKSMFEAKLITKLLPDYVERNYTGEDKEKALETLALFKGFTTYFKGYFKTRKNMFSGEGGASSICHRIVNVNASIFYDNLKTFMRIQEKAGDEIALIEEELTEKLDGWRLEHIFSRDYYNEVLAQKGIDYYNQICGDINKHMNLYCQQNKFKANIFKMMKLQKQIMGISEKVFEIPPMYQNDEEVYASFNEFISRLEEVKLTDRLRNILQNINIYNTAKIYINARYYTNVSTYVYGGWGVIESAIERYLCNTIAGKGQSKVKKIENAKKDNKFMSVKELDSIVAEYEPDYFNAPYIDDDDNAVKVFGGQGVLGYFNKMSELLADVSLYTIDYNSDDSLIENKESALRIKKQLDDIMSLYHWLQTFIIDEVVEKDNAFYAELEDICCELENVVTLYDRIRNYVTRKPYSTQKFKLNFASPTLASGWSRSKEFDNNAIILLRNNKYYIAIFNVNNKPDKQIIKGSEEQRLSTDYKKMVYNLLPGPNKMLPKVFIKSDTGKRDYNPSSYILEGYEKNRHIKSSGNFDINYCHDLIDYYKACINKHPEWKNYGFKFKETNQYNDIGQFYKDVEKQGYSISWAYISEEDINKLDEEGKIYLFEIYNKDLSAHSTGRDNLHTMYLKNIFSEDNLKNICIELNGEAELFYRKSSMKSNITHKKDTILVNKTYINETGVRVSLSDEDYMKVYNYYNNNYVIDTENDKNLIDIIEKIGHRKSKIDIVKDKRYTEDKYFLYLPITINYGIEDENVNSKIIEYIAKQDNMNVIGIDRGERNLIYISVIDNKGNIIEQKSFNLVNNYDYKNKLKNMEKTRDNARKNWQEIGKIKDVKSGYLSGVISKIARMVIDYNAIIVMEDLNKGFKRGRFKVERQVYQKFENMLISKLNYLVFKERKADENGGILRGYQLTYIPKSIKNVGKQCGCIFYVPAAYTSKIDPATGFINIFDFKKYSGSGINAKVKDKKEFLMSMNSIRYINEGSEEYEKIGHRELFAFSFDYNNFKTYNVSSPVNEWTAYTYGERIKKLYKDGRWLRSEVLNLTENLIKLMEQYNIEYKDGHDIREDISHMDETRNADFICSLFEELKYTVQLRNSKSEAEDENYDRLVSPILNSSNGFYDSSDYMENENNTTHTMPKDADANGAYCIALKGLYEINKIKQNWSDDKKFKENELYINVTEWLDYIQNRRFE

SEQ ID NO: 128 - protein, 1262 aa, Unknown
  Bacteroidetes oral taxon 274 str. F0058
MRKFNEFVGLYPISKTLRFELKPIGKTLEHIQRNKLLEHDAVRADDYVKVKKIIDKYHKCLIDEALSGFTFDTEADGRSNNSLSEYYLYYNLKKRNEQEQKTFKTIQNNLRKQIVNKLTQSEKYKRIDKKELITTDLPDFLTNESEKELVEKFKNFTTYFTEFHKNRKNMYSKEEKSTAIAFRLINENLPKFVDNIAAFEKVVSSPLAEKINALYEDFKEYLNVEEISRVFRLDYYDELLTQKQIDLYNAIVGGRTEEDNKIQIKGLNQYINEYNQQQTDRSNRLPKLKPLYKQILSDRESVSWLPPKFDSDKNLLIKIKECYDALSEKEKVFDKLESILKSLSTYDLSKIYISNDSQLSYISQKMFGRWDIISKAIREDCAKRNPQKSRESLEKFAERIDKKLKTIDSISIGDVDECLAQLGETYVKRVEDYFVAMGESEIDDEQTDTTSFKKNIEGAYESVKELLNNADNITDNNLMQDKGNVEKIKTLLDAIKDLQRFIKPLLGKGDEADKDGVFYGEFTSLWTKLDQVTPLYNMVRNYLTSKPYSTKKIKLNFENSTLMDGWDLNKEPDNTTVIFCKDGLYYLGIMGKKYNRVFVDREDLPHDGECYDKMEYKLLPGANKMLPKVFFSETGIQRFLPSEELLGKYERGTHKKGAGFDLGDCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKDVVYKLNGEAEVFFRKSSITVQSPTHPANSPIKNKNKDNQKKESKFEYDLIKDRRYTVDKFLFHVPITMNFKSVGGSNINQLVKRHIRSATDLHIIGIDRGERHLLYLTVIDSRGNIKEQFSLNEIVNEYNGNTYRTDYHELLDTREGERTEARRNWQTIQNIRELKEGYLSQVIHKISELAIKYNAVIVLEDLNFGFMRSRQKVEKQVYQKFEKMLIDKLNYLVDKKKPVAETGGLLRAYQLTGEFESFKTLGKQSGILFYVPAWNTSKIDPVTGFVNLFDTHYENIEKAKVFFDKFKSIRYNSDKDWFEFVVDDYTRFSPKAEGTRRDWTICTQGKRIQICRNHQRNNEWEGQEIDLTKAFKEHFEAYGVDISKDLREQINTQNKKEFFEELLRLLRLTLQMRNSMPSSDIDYLISPVANDTGCFFDSRKQAELKENAVLPMNADANGAYNIARKGLLAIRKMKQEENDSAKISLAISNKEWLKFAQTKPYLED

SEQ ID NO: 129 - protein, 998 aa, Unknown
  Arcobacter butzleri L348 isolate CHRB125
MGLLEHLEGAIVEDMFSLDYFSLTLSQRYIDIYNTMIGGNTLADGTKVQGINENINIYRQKNNIDRKNLPTLKPLHKQLLSDRETLSWIPEAFKTKEEVVGAIEDFYKNNIISFKCCDNIVDITKQFIDIFSLNEDYELNKIFIKNDISITSISQDIFKDYRIIKEALWQKHINENPKAAKSKDLTGDKEKYFSRKNSFFSFEEIISSLKLMGRKIDLFSYFKDNVEYRAHSIETTFIKWQKNKNDKKTTKELLDNILNLQRVLKPLYLKAEVEKDILFYSIFDIYFESLNEIVKLYNKVRDFESKKPYSLEKFKLNFQNSTLLSGWDVNKEPDNTSILLKKDGLYYLGIMDKKHNRVFKNLESSKGGYEKIEYKLLSGPNKMLPKVFFSNKSIGYYNPSPALLEKYKSGVHKKGESFDLNFCHELIDFFKASIDKHEDWKNFNFKFSDTSEYADISGFYREVEQQGYKITFKNIDEEFINTLINEGKLYLFQIYNKDFSTFSKGTKNLHTLYWEMIFNEENLKNVVYKLNGEAEIFYRKKSIEYSEDKMKYGHHYEELKDKFNYPIIKDKRFTMDKFQFHVPITMNFKATGRSYINEEVNDFLRQNSKDVKIIGINRGERHLIYLTMINAKGEIIQQYSLNEIVNSYNNKNFTVNYNEKLSKKEGERAIARENWGVVENIKELKEGYLSHAIHTISNLIVENNAIVVLEDLNFEFKRERLKVEKSIYQKFEKMLIDKLNYLVDKKKDINENGGLLKALQLTNKFESFEKIGKQNGFLFFVNAWNITKICPVTGFVSLFDTRYQSVDKAREFFSKFDSIKYNEEKEHYEFVFDYSNFTDKAKDTKTKWTVCSYGTRIKTFRNSEKNNNWDNKTVSPTEDLSKLLKSCDRDIKEFIISQDKKEFFVELLEIFSLIVQMKNSIINSEIDYIISPVANENGEFFDSRFANSSLPKNADANAAYNTARKGLMLLEKIRDSEIGKKIDMKITNTEWLNFVQER

SEQ ID NO: 130 - protein, 1242 aa, Unknown
  Bacteroidales bacterium KA00251
MKKFTNLYPVQKTLRFELIPQGNTSKHLCKIIQEDEQIAEDSQEVKKLLDRYHKEFIAIALSSFPTSPLAKEIIPKLKEFAQIRATGDAKQISTIQDELRELVVKGFKGEGEQERRYKILIGAKGNPNADELFNTELINFLKDPAEQALVKKFQKHTGYFLGFNENRKNMYSAKAQSTAIAYRLIHENLPRFLDNITTYEKVKTYLKEEIPQLEKELVRAGASLVSHVDSVFTIDFFLEVFTQSGIDQYNALIGKIVNQEQGEVKGLNERINLYNQQHKQEAKLPLFKPLYKQILSDREQLSWLAEAYNSDKDLLDSIQKYYQLLIDNQIFERIPRLMHTLEKAPLDKIWITYDTQLTSISNTLYGSWRVIGEALGRNAKSEKERKSSQKKALNYSLESINQAIAKMPSDEELPPIQKYFIALGSNPSKKDASSGTLVDKVRSSYKACQDILTNPDHTGKKLIQDKKQVDLLKQLLDDLLILQRFIKPLLYSNNENETHKDEVFYTELTDIMDLLNPIVGLYNKVRNYLTQKPYSTEKFKINFKSSSLLAGWDRNKEKDNLGVILKREDKYYLAIMDKAHNATFKNKSLPTQGECYEKMEYKLLPGANKMLPKVYITSKKGIESFHPSEELQKKYKLGTHKKGASFNLSDMRALIDYFKESLEKHEEHSQFGFHFSDTSTYEDISGFYREVEQQAYKITFRKVSVEYIDQLVNEGKLYLFQIYNKDFSPYSKGTPNLHTLYWKMLFDPANLQDIVYKLNGEAEVFFRKKSLQYDRPTHPKGQPINKKSLLNEGETSLFDYDLIKDRRFTVDKFQFHVPITMNFKATQGTKVNQMVQEEVKKSKGFHLIGIDRGERNLLYIVVINERGEIIEQCSLNKIVNTYQEKEHTVDYKALLEKRSQSRLEERKSWQTIENIKELKGGYLSQVVHKIAQLMIKYNAIAVLEDLNFGFIRTRKKFEFSVYQEFEKKLIDKLGYVVDKKAPIQQEGGLLQAYQLTAPFKSFREMGKQNGFLFYVPAWNTSAIDPRTGFVNLLDTRYESIAKTKELIKKLKDIRYNSQKDWFEIDLDYNAFGNRAKGSRSKWRLCSYGERIEHTRKQDSNGQEESDSMVVLTEAFKDVFTKYQIDYRENLKEQLLLQSDKAFFVDFLSLLRLTLQLRNSLSNSLIDYILSPVADENGEFFDSRKALSNEPQDADANGAYHIALKGLWVLDKIRKTEKVTPAKLALSNQEWLSFAQEKPFFNE

SEQ ID NO: 131 - protein, 1302 aa, Unknown
  Acidaminococcus massiliensis strain Marseille-P2828
MAAFDKFIHQYQVSKTLRFALIPQGKTLENTKNNVLQEDDERQKNYEKVKPILDRIYKVFAEESLKDCSVDWNDLNACLDAYQKNPSADKRQKVKAAQDALRDEIAGYFTGKQYANGKNKNAVKEKEQAELYKDIFSKKIFDGTVTNNKLPQVNLSAEETELLGCFDKFTTYFVGFYQNRENVFSGEDIATAIPHRIVQDNFPKFRENCRIYQDLIKNEPALKPLLQQAAAAVMAQNPKGIYQPRKSLDDIFVIPFYNHLLLQDDIDYFNQILGGISGAAGQKKIQGLNETINLFMQQHPQEADKLKKKKIRHRFIPLYKQILSDRTSFSFIPEAFSNSQEALDGIETFKKSLKKNDTFGALERLIQNLASLDLKYVYLSNKKVNEISQALYGEWHCIQDVLKQDFSLESLIQINPQNSSNGFLATLTDEGKKRISQCRNVLGNPLPVKLADDQDKAQVKNQLDTLLAAVHYLEWFKADPDLETDPNFTVPFEKIWEELVPLLSLYSKVRNFVTKKPYSTAKFKLNFANPTLADGWDIHKESDNGALLFEKGGLYYLGIMNPKDKPNFKSYQGAEPYYQKMVYRFFPDCSKTIPKCSTQRKDVKKYFEDHPQATSYQIHDSKKEKFRQDFFEIPREIYELNNTTYGTGKSKYKKFQTQYYQKTQDKSGYQKALRKWIDFSKKFLQTYVSTSIFDFKGLRPSKDYQDLGEFYKDVNSRCYRVTFEKIRVQDIHEAVKNGQLYLFQLYNKDFSPKSHGLPNLHTLYWKAVFDPENLKDPIVKLNGQAELFYRPKSNMQIIQHKTGEEIVNKKLKDGTPVPDDIYREISAYVQGKCQGNLSPEAEKWLPSVTIKKAAHDITKDRRFTEDKFFFHVPITLNYQSSGKPTAFNSQVNDFLTEHPETNIIGIDRGERNLIYAVVITPDGKILEQKSFNVIHDFDYHESLSQREKQRVAARQAWTAIGRIKDLKEGYLSLVVHEIAQMMIKYQAVVVLENLNTGFKRVRGGISEKAVYQQFEKMLIEKLNFLVFKDRAINQEGGVLKAYQLTDSFTSFAKLGNQSGFLFYIPSAYTSKIDPGTGFVDPFIWSHVTASEENRNEFLKGFDSLKYDAQSSAFVLHFKMKSNKQFQKNNVEGFMPEWDICFEKNEEKISLQGSKYTAGKRIIFDSKKKQYMECFPQNELMKALQDVGITWNTGNDIWQDVLKQASTDTGFRHRMINLIRSVLQMRSSNGATGEDYINSPVMDLDGRFFDTRAGIRDLPLDADANGAYHIALKGRMVLERIRSQKNTAIKNTDWLYAIQEERN

SEQ ID NO: 132 - protein, 1310 aa, Helcococcus kunzii
MFEKLSNIVSISKTIRFKLIPVGKTLENIEKLGKLEKDFERSDFYPILKNISDDYYRQYIKEKLSDLNLDWQKLYDAHELLDSSKKESQKNLEMIQAQYRKVLFNILSGELDKSGEKNSKDLIKNNKALYGKLFKKQFILEVLPDFVNNNDSYSEEDLEGLNLYSKFTTRLKNFWETRKNVFTDKDIVTAIPFRAVNENFGFYYDNIKIFNKNIEYLENKIPNLENELKEADILDDNRSVKDYFTPNGFNYVITQDGIDVYQAIRGGFTKENGEKVQGINEILNLTQQQLRRKPETKNVKLGVLTKLRKQILEYSESTSFLIDQIEDDNDLVDRINKFNVSFFESTEVSPSLFEQIERLYNALKSIKKEEVYIDARNTQKFSQMLFGQWDVIRRGYTVKITEGSKEEKKKYKEYLELDETSKAKRYLNIREIEELVNLVEGFEEVDVFSVLLEKFKMNNIERSEFEAPIYGSPIKLEAIKEYLEKHLEEYHKWKLLLIGNDDLDTDETFYPLLNEVISDYYIIPLYNLTRNYLTRKHSDKDKIKVNFDFPTLADGWSESKISDNRSIILRKGGYYYLGILIDNKLLINKKNKSKKIYEILIYNQIPEFSKSIPNYPFTKKVKEHFKNNVSDFQLIDGYVSPLIITKEIYDIKKEKKYKKDFYKDNNTNKNYLYTIYKWIEFCKQFLYKYKGPNKESYKEMYDFSTLKDTSLYVNLNDFYADVNSCAYRVLFNKIDENTIDNAVEDGKLLLFQIYNKDFSPESKGKKNLHTLYWLSMFSEENLRTRKLKLNGQAEIFYRKKLEKKPIIHKEGSILLNKIDKEGNTIPENIYHECYRYLNKKIGREDLSDEAIALFNKDVLKYKEARFDIIKDRRYSESQFFFHVPITFNWDIKTNKNVNQIVQGMIKDGEIKHIIGIDRGERHLLYYSVIDLEGNIVEQGSLNTLEQNRFDNSTVKVDYQNKLRTREEDRDRARKNWTNINKIKELKDGYLSHVVHKLSRLIIKYEAIVIMENLNQGFKRGRFKVERQVYQKFELALMNKLSALSFKEKYDERKNLEPSGILNPIQACYPVDAYQELQGQNGIVFYLPAAYTSVIDPVTGFTNLFRLKSINSSKYEEFIKKFKNIYFDNEEEDFKFIFNYKDFAKANLVILNNIKSKDWKISTRGERISYNSKKKEYFYVQPTEFLINKLKELNIDYENIDIIPLIDNLEEKAKRKILKALFDTFKYSVQLRNYDFENDYIISPTADDNGNYYNSNEIDIDKTNLPNNGDANGAFNIARKGLLLKDRIVNSNESKVDLKIKNEDWINFIIS

SEQ ID NO: 133 - protein, 1263 aa, Unknown
  Agathobacter rectalis strain 2789STDY5834884
MNNGTNNFQNFIGISSLQKTLRNALTPTETTQQFIVKNGIIKEDELRGENRQILKDIMDDYYRGFISETLSSIDDIDWTSLFEKMEIQLKNGDNKDTLIKEQAEKRKAIYKKFADDDRFKNMFSAKLISDILPEFVIHNNNYSASEKEEKTQVIKLFSRFATSFKDYFKNRANCFSADDISSSSCHRIVNDNAEIFFSNALVYRRIVKNLSNDDINKISGDMKDSLKKMSLEKIYSYEKYGEFITQEGISFYNDICGKVNSFMNLYCQKNKENKNLYKLRKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCPDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPEKKIIEGNTSENKGDYKKMIYNLLPGPNKMIPKVFLSSKTGVETYKPSAYILEGYKQNKHLKSSKDFDITFCRDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDVVLKLNGEAEIFFRKSSIKNPIIHKKGSILVNRTYEAEEKDQFGNIQIVRKTIPENIYQELYKYFNDKSDKELSDEAAKLKNAVGHHEAATNIVKDYRYTYDKYFLHMPITINFKANKTSFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPEKLKNVGHQCGCIFYVPAAYTSKIDPTTGFVNIFKFKDLTVDAKREFIKKFDSIRYDSDKNLFCFTFDYNNFITQNTVMSKSSWSVYTYGVRIKRRFVNGRFSNESDTIDITKDMEKTLEMTDINWRDGHDLRQDIIDYEIVQHIFEIFKLTVQMRNSLSELEDRNYDRLISPVLNENNIFYDSAKAGDALPKDADANGAYCIALKGLYEIKQITENWKEDGKFSRDKLKISNKDWFDFIQNKRYL

SEQ ID NO: 134 - protein, 1307 aa, Unknown
  Acidaminococcus sp. BV3L6
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 135 - protein, 1246 aa, Unknown
  Lachnospiraceae bacterium ND2006
MLKNVGIDRLDVEKGRKNMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 136 - protein, 1300 aa, Unknown
  Francisella tularensis subsp. novicida U112
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 137 - protein, 1067 aa, Unknown
  Omnitrophica WOR_2 bacterium GWF2_38_59
MKNGINLFKTKTTKTKGVDMEKYQITKTIRFKLLPDNAHEIVEKVKSLKTSNVDELMDEVKNVHLKGLELLFALKKYFYFDGNQCKSFKSTLEIKARWLRLYTPDQYYLKKSSKNSYQLKSLSYFKDVFNDWLFNWEESVSELAIIYEKYKICQHQRDSRADIALLIKKLSMKEYFPFISDLIDCVNDKNSNKTFLMKLSEELSVLLEKCNSRALPYQSNGIVVGKASLNYYTVSKSEKMLQNEYEDVCQSLDKNYDITEMKVILYKEKLDNLNFKDVTIANAYNLLKENKALQKRLFSEYVSQGKVLSLIKTELPLFSNINDNDFEKYKEWSNEIKKLADKKNTFCKKTQQDKIKDIQNKISELKKKRGALFQYKFTSFQKHCDNYKKVAVQYGKLKARKKAIEKDEIEANLLRYWSVILEQEDKHSLVLIPKNNAKDAKQYIETINTKGGKYIIHHLDSLTLRALNKLCFNAVDIEKGQMVRENTFYQGIKEEFERNKINCDNQGVLKIQGLYSFKTEGGQINEKEAVEFFKEVLKSNYAREVLNLPYDLESNIFQKEYTNLDQFRQDLEKCCYALHSKIGKDDLDEFTRRFEAQVFDITSIDLKSKKEKTKTTGEMKKHTQLWLEFWKGAIEQNFATRVNPELSIFWRAPKSSREKKYGKGSDLYDPNKNNRYLYEQYTLALTITENAGSHFKDIAFKDTSKIKEAIKEFNMSLSQSKYCFGIDRGNAELVSLCLIKNEKDFPFEKFPVYRLRDLTYQGDFKDKHDQMRYGVAIKNISYFIDQEDLFEKNNLSAIDMTTAKLIKNKIVLNGDVLTYLKLKEETAKHKLTQFFQGSSINKNSRVYFDEDENVFKITTNRNHNPEEIIYFYRGEYGAIKNKNDLEDILNEYLCKMETGESEIVLLNRVNHLRDAISANIVGILSYLIDLFPETIVALENLAKGTIDRHVSQSYENITRRFEWALYRKLLNKQLAPPELKENILLREGDDKIDQFGIIHFVEEKNTSKDCPNCRKTTQQTNDNKFKEKKFVCKSCGFDTSKDRKGMDSLNSPDTVAAYNVARKKFES

SEQ ID NO: 138 - protein, 1057 aa, Unknown
  Candidatus Roizmanbacteria bacterium GW2011_GWA2_37_7 US54_C0016
MEIQELKNLYEVKKTVRFELKPSKKKIFEGGDVIKLQKDFEKVQKFFLDIFVYKNEHTKLEFKKKREIKYTWLRTNTKNEFYNWRGKSDTGKNYALNKIGFLAEEILRWLNEWQELTKSLKDLTQREEHKQERKSDIAFVLRNFLKRQNLPFIKDFFNAVIDIQGKQGKESDDKIRKFREEIKEIEKNLNACSREYLPTQSNGVLLYKASFSYYTLNKTPKEYEDLKKEKESELSSVLLKEIYRRKRFNRTTNQKDTLFECTSDWLVKIKLGKDIYEWTLDEAYQKMKIWKANQKSNFIEAVAGDKLTHQNFRKQFPLFDASDEDFETFYRLTKALDKNPENAKKIAQKRGKFFNAPNETVQTKNYHELCELYKRIAVKRGKIIAEIKGIENEEVQSQLLTHWAVIAEERDKKFIVLIPRKNGGKLENHKNAHAFLQEKDRKEPNDIKVYHFKSLTLRSLEKLCFKEAKNTFAPEIKKETNPKIWFPTYKQEWNSTPERLIKFYKQVLQSNYAQTYLDLVDFGNLNTFLETHFTTLEEFESDLEKTCYTKVPVYFAKKELETFADEFEAEVFEITTRSISTESKRKENAHAEIWRDFWSRENEEENHITRLNPEVSVLYRDEIKEKSNTSRKNRKSNANNRFSDPRFTLATTITLNADKKKSNLAFKTVEDINIHIDNFNKKFSKNFSGEWVYGIDRGLKELATLNVVKFSDVKNVFGVSQPKEFAKIPIYKLRDEKAILKDENGLSLKNAKGEARKVIDNISDVLEEGKEPDSTLFEKREVSSIDLTRAKLIKGHIISNGDQKTYLKLKETSAKRRIFELFSTAKIDKSSQFHVRKTIELSGTKIYWLCEWQRQDSWRTEKVSLRNTLKGYLQNLDLKNRFENIETIEKINHLRDAITANMVGILSHLQNKLEMQGVIALENLDTVREQSNKKMIDEHFEQSNEHVSRRLEWALYCKFANTGEVPPQIKESIFLRDEFKVCQIGILNFIDVKGTSSNCPNCDQESRKTGSHFICNFQNNCIFSSKENRNLLEQNLHNSDDVAAFNIAKRGLEIVKV

SEQ ID NO: 139 - RNA, 78 nt, Unknown
  Uncultured Clostridium sp. isolate 2789STDY5608795
cagucuuaauaaacgaaaaagaauauauuacuuaaccagaugugugcaaaugugauaaaaagaauaaguuuaaauaag

SEQ ID NO: 140 - RNA, 67 nt, Unknown
  Uncultured bacterium (gcode 4) ACD_3C00058, whole genome shotgun sequence
agagaaaaaugcaaaccuaagucuuaauuuuuucaccuuccuacagauaagccaaaagucguaauuu

SEQ ID NO: 141 - RNA, 81 nt, Unknown
  Thiomicrospira sp. XS5 ZB100000
uucucugauaaaauaauuaacucaggucuuuucgagaaaaaacugcaaaccuuggucuuaaugagaaaaaucaugaaaaaa

SEQ ID NO: 142 - RNA, 82 nt, Unknown
  Flavobacterium branchiophilum FL-15
caugaaaacaagcuuucgaaugcuguuuuuuuauuuaaaagcaaccaaaaacgguaaaaaaggguuguuuuugugucauuuu

SEQ ID NO: 143 - RNA, 63 nt, Unknown
  Moraxella bovoculi strain 57922
gucuaacgaccuuuuaaauuucuacuguuuguagauauucgugcguauuugauuucuuugugu

SEQ ID NO: 144 - RNA, 85 nt, Unknown
  Candidatus Roizmanbacteria bacterium GW2011_GWA2_37_7 US54_C0016
aauggaaaaaguggaaauuguauuaucaguacaaaaccuaagucuuuauuuuuuugaagacgauguagaguuguagucuaaugag

SEQ ID NO: 145 - RNA, 84 nt, Unknown
  Pseudobutyrivibrio xylanivorans
accuauaacuuaauuuguggauacuaagucuugagugaugaaaauggcaguuuuguuaguaaauaaacauaauaauaugaugaa

SEQ ID NO: 146 - RNA, 83 nt, Unknown
  Prevotella bryantii B14
auauacgauauuauguuuuagccuacauuuucauaaaguucugauaucaaacacauuauaaacuuuuauauaacaaucaagaa

SEQ ID NO: 147 - RNA, 63 nt, Unknown
  Smithella sp. SCADC
uuaugguguuucagcaauuuaaucuugcgcgugaaagaaaaaugugcuuauuaaacaacuaua

SEQ ID NO: 148 - RNA, 57 nt, Unknown
  Smithella sp. SCADC
aaaaauuggcugauuuuaugguguuucagcaauuuaaucuugcgcgugaaagaaaaa

SEQ ID NO: 149 - RNA, 82 nt, Unknown
  Bacteroidetes bacterium GWF2_33_38
gcacaaagaagcaaagcuuuuuuaaaaagcuuugcuucuaaaacaauuaguuauuugaaauaguuguauuuuuuuuuuacga

SEQ ID NO: 150 - RNA, 74 nt, Unknown
  Candidatus Peribacteria bacterium RIFCSPLOWO2
aaauccauauguggauaucucaucuugcagaccaucguccuuauuuucuuaagaagaccucuucaaaccaaaaa

SEQ ID NO: 151 - RNA, 74 nt, Unknown
  Nitrospinae bacterium RIFCSPLOWO2
uucuacuauuguagaucaaaccucggucuuaauguaaaaaauggcgcuuggacuggcggucaaaaccacaaaaa

SEQ ID NO: 152 - RNA, 67 nt, Unknown
  Candidatus Ryanbacteria bacterium RIFCSPHIGHO2
cucgugaaagguggaaauccagugaagguauuugguuuaauauguauauuacgagauaugcgggaaa

SEQ ID NO: 153 - RNA, 85 nt, Unknown
  Candidatus Wildermuthbacteria bacterium RIFCSPHIGHO2
uuauacugaagcauaaaguauaaauugcguguggauauuaauuuagacucaauauauaacgguggaaaaccuuugccuuuauaaa

SEQ ID NO: 154 - RNA, 59 nt, Unknown
  Firmicutes bacterium CAG_194_44_15
gucuuucuauuuaguuuuaauuuuagguuacuugacaauaugguaauaauaaacaaaau

SEQ ID NO: 155 - RNA, 83 nt, Unknown
  Candidatus Gottesmanbacteria bacterium CG1_02_37_22
auuauaaaagcagaagugaaacuguuaauauuugagaaaacuuaagucuuuaugagccuguuucuugcuauuuuacgccuaaa

SEQ ID NO: 156 - RNA, 87 nt, Unknown
  Candidatus Gracilibacteria bacterium CG1_02_38_174
aacaaggguggaaaucuuuauguuggguuuuacgaaaacugcaaaccucagucuucauuuuuugcgaguaccguuuuaagccaagaa

SEQ ID NO: 157 - RNA, 76 nt, Unknown
  Butyrivibrio fibrisolvens MD2001
aaccuccgauuugauuuuuauuuauggguucuuggaaauaauauaugggcaaauuauuggugauaaguuauaaaaa

SEQ ID NO: 158 - RNA, 60 nt, Unknown
  Sneathia amnii strain SN35
aaucaagguguuaauauuuuuaaaaugcgaaaaaaucaaaucucucaaauguaaaaaaaa

SEQ ID NO: 159 - RNA, 73 nt, Unknown
  Coprococcus eutactus strain 2789STDY5608843
cagucuuucugaggaaaaauuaagggguuacucaacagauaugaacauaacaaacaaaaaaagaauguauaua

SEQ ID NO: 160 - RNA, 65 nt, Unknown
  Lachnospira pectinoschiza strain 2789STDY5834886
ugaccuuaauauuuaaaauuagauggguuacuuaauauaauauguguauauugcauaaaaaauaa

SEQ ID NO: 161 - RNA, 80 nt, Unknown
  Bacteroidetes oral taxon 274 str. F0058
auggagaauacaaaguuugauuauugucuugauaauaaauaaacuaugaaaauuuguuuuuugcagggggggauaaaaua

SEQ ID NO: 162 - RNA, 63 nt, Unknown
  Arcobacter butzleri L348 isolate CHRB125
uauggaaauauuguuaaaaaauauaaauuuuaagaggguaaauaagcuuuuuuaauaugauuu

SEQ ID NO: 163 - RNA, 65 nt, Unknown
  Bacteroidales bacterium KA00251
acucccuauuauucaacuaaaaaaggccauuuuccccgaucauuuagaagagagagggggggaaa

SEQ ID NO: 164 - RNA, 67 nt, Unknown
  Acidaminococcus massiliensis strain Marseille-P2828
agugaaaaucguggaaaaucacuugguacaauggacgggaacacuauauauuguggcagacuccaag

SEQ ID NO: 165 - RNA, 71 nt, Helcococcus kunzii
uucuuaaaggauaucuaaaaauguauucauuaaaugagaguuuaugcauugcaauacuaacuauagugaca

SEQ ID NO: 166 - RNA, 57 nt, Unknown
  Agathobacter rectalis strain 2789STDY5834884
uggaccuuaauuuuauaauaaucuauauuacuuaacauauuuugugcaaauguuaua

SEQ ID NO: 167 - RNA, 72 nt, Unknown; identical to SEQ ID NO: 6
  Acidaminococcus sp. BV3L6

SEQ ID NO: 168 - RNA, 65 nt, Unknown; identical to SEQ ID NO: 3
  Lachnospiraceae bacterium ND2006

SEQ ID NO: 169 - RNA, 81 nt, Unknown
  Francisella tularensis subsp. novicida U112
aaguucuuagagauauuuaaaaauaugacuguuguuauauaucaaaaugcuaaaaaaaucauagauuuuaggucuuuuuuu

SEQ ID NO: 170 - RNA, 72 nt, Unknown
  Omnitrophica WOR_2 bacterium GWF2_38_59
gccuuuauuuauuggacuuacgaaaauacucuuaaaaacuaugaugcuguaaauuguugggguaucguuugu

SEQ ID NO: 171 - RNA, 69 nt, Unknown
  Candidatus Roizmanbacteria bacterium GW2011_GWA2_37_7 US54_C0016
auggaaaaaguggaaauuguauuaucaguacaaaaccuaagucuuuauuuuuuugaagacgauguagag

SEQ ID NO: 172 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSDDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILANFAAIPMIFDEIAQNKDNLAQISLKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGNPQKGYEKFEFNIEDCRKFIDFYKESISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEHNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 173 - DNA, 36 bp, Unknown
  Lachnospiraceae bacterium ND2006
gtttcaaagattaaataatttctactaagtgtagat

SEQ ID NO: 174 - DNA, 28 bp, Unknown
  Lachnospiraceae bacterium ND2006
cggtctcgcaaagaatggatatactcat

SEQ ID NO: 175 - DNA, 49 bp, Unknown
  Lachnospiraceae bacterium ND2006
taatttctactaagtgtagatcggtctcgcaaagaatggatatactcat

SEQ ID NO: 176 - DNA, 35 bp, Unknown
  Acidaminococcus sp. BV3L6
gtcaaaagacctttttaatttctactcttgtagat

SEQ ID NO: 177 - DNA, 26 bp, Unknown
  Acidaminococcus sp. BV3L6
gtctaaactggtcgaaatcgaccagt

SEQ ID NO: 178 - DNA, 46 bp, Unknown
  Acidaminococcus sp. BV3L6
taatttctactcttgtagatgtctaaactggtcgaaatcgaccagt

SEQ ID NO: 179 - RNA, 41 nt, Artificial sequence
  Synthetic construct
uaauuucuacucuuguagauuggacagagcuccaagugacc

SEQ ID NO: 180 - RNA, 19 nt, Artificial sequence
  Synthetic construct
uaauuucuacucuuguaga

SEQ ID NO: 181 - RNA, 21 nt, Artificial sequence
  Synthetic construct
uggacagagcuccaagugacc

SEQ ID NO: 182 - protein, 1259 aa, Artificial sequence
  Synthetic construct
GPAGSGGPKKKRKVGGSGMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGGSGPKKKRKVGG

SEQ ID NO: 183 - DNA, 5 bp, Artificial sequence
  Synthetic construct
ggtga

SEQ ID NO: 184 - DNA, 5 bp, Artificial sequence
  Synthetic construct
ggtga

SEQ ID NO: 185 - DNA, 6 bp, Artificial sequence
  Synthetic construct
  misc_feature (4)..(4): R is A or G
tccrac

SEQ ID NO: 186 - DNA, 5 bp, Artificial sequence
  Synthetic construct
  misc_feature (3)..(3): S is G or C
ttsaa

SEQ ID NO: 187 - DNA, 11 bp, Artificial sequence
  Synthetic construct
  misc_feature (3)..(9): N is A, C, G, or T
gcnnnnnnngc

SEQ ID NO: 188 - DNA, 4 bp, Artificial sequence
  Synthetic construct
gcgc

SEQ ID NO: 189 - DNA, 4 bp, Artificial sequence
  Synthetic construct
gcgc

SEQ ID NO: 190 - DNA, 4 bp, Artificial sequence
  Synthetic construct
gcgc

SEQ ID NO: 191 - DNA, 6 bp, Artificial sequence
  Synthetic construct
  misc_feature (2)..(2): R is A or G
  misc_feature (5)..(5): Y is C or T
grcgyc

SEQ ID NO: 192 - DNA, 6 bp, Artificial sequence
  Synthetic construct
  misc_feature (1)..(1): R is A or G
  misc_feature (6)..(6): Y is C or T
rgcgcy

SEQ ID NO: 193 - DNA, 6 bp, Artificial sequence
  Synthetic construct
  misc_feature (3)..(4): N is A, C, G, or T
ggnncc

SEQ ID NO: 194 - DNA, 6 bp, Artificial sequence
  Synthetic construct
ggcgcc

SEQ ID NO: 195 - DNA, 6 bp, Artificial sequence
  Synthetic construct
ggcgcc

SEQ ID NO: 196 - DNA, 6 bp, Artificial sequence
  Synthetic construct
ggcgcc

SEQ ID NO: 197 - DNA, 6 bp, Artificial sequence
  Synthetic construct
ggcgcc

SEQ ID NO: 198 - DNA, 6 bp, Artificial sequence
  Synthetic construct
  misc_feature (3)..(3): Y is C or T
  misc_feature (4)..(4): R is A or G
ggyrcc

SEQ ID NO: 199 - DNA, 6 bp, Artificial sequence
  Synthetic construct
atgcat

SEQ ID NO: 200 - DNA, 6 bp, Artificial sequence
  Synthetic construct
gaatgc

SEQ ID NO: 201 - DNA, 10 bp, Artificial sequence
  Synthetic construct
  misc_feature (3)..(3): Y is C or T
  misc_feature (4)..(7): N is A, C, G, or T
  misc_feature (8)..(8): R is A or G
caynnnnrtg

SEQ ID NO: 202 - DNA, 5 bp, Artificial sequence
  Synthetic construct
atgaa

SEQ ID NO: 203 - DNA, 6 bp, Artificial sequence
  Synthetic construct
catatg

SEQ ID NO: 204 - protein, 1267 aa, Butyrivibrio hungatei
MLYDEYSTQYYKGDEKRPMLNYEEFTKRNHITKALRMELIPQGKTQNVIDEKGDRKYDAALYSSLERLKPVIDSFIRSTASRALSDVDYDFNAMHDAYINKDKKSWAKEEKALKKVLMKAVDEALPKGLKCSQINSAAFLQEVLREYVLHATDTELRKDVALKDIEETKGCLALFSKFLTTRITALTVWMPERVIENFKIYCSNIPRIEAIFNEAKDIANNYSDELELMKTAQYYTKILSQDAIDGYNLVIAGKITENGIETKGLNVLINEYNIDVKNQKLDKPYLRKINQLYKQTLFSSEKQFVITAIKTDDEVRRVIKSAWESFDGAATKMLGLFKETLEATNGNGVCVKGNRLHILSHALLGEHKAITDNLVKAELVEIHEMLKNEALKPSMRAELEKRVDIAQSLVVKKDYSFTALDEAVTSIDENVIGLSKGAFNLYVAKTEELIKEAKMYYKVLEGGDIFKKRHIKGDKHVQEMLVDFFDALTEVRNIISVISMPDENEDADVSFYNRFDEIYENIRLTYKAENLVRNYITKSVKDTAEEKQTCFGTPARLRTQWWNGEQKFAKNHAAIIKHDGKYYYFILAGDSKPIEIKEDGNSATGLLTLKKGQKSFMMLPKILFTDHAVPFFEGNKDAMEYTLDDESVIRPVKVGRMLYEIYKKGLFKREAVTSGAITEEEYAKNIQALIEKYTEFANAYVQYQKFNLDDINDPTRYSDIGEFFSEVDTCTSRLSWTYIDYAQIANLVDSGSAYLFLISTKFLYTESEDKNAYTKTFRSILSDANMDKTTILLNSNPAVFFRPQSIKKEITHKAGSIMVNKLTEDGEHIPKKIYEAIYKSKNEMSGVSEEDMAAANEYMRTHKVRSFKAKYDKTYRGNYMSDKYTLQLTYTKNNDVSDRVNDMLNDRVIEAMQDGFNIVSVARSTKDMVYALVLDSSLKIIKELSLNVIDGVDYYALLHDTYLEKKENKKLWIYDTENTELKSAYIDLAISEILKLAREYNAVIAVESISDAVKNKYSFIDNQVFKAFENRIAQRLSDLTYKDVVDGRPGSVSNPLQLSNNNGNTYQDGILFFINGAYTRGIDPSSGFTSLFDFSRYNSIASKRQFFSKMAKISYTGDSIVFDFDYVDYPVHVDTEKTKWQVKLSGDVVVYDREKKQNKRIKDVVNEIIIPLAGKTDLNGNIAENILNKDVPGAFVEELFRWFRYAVTGIHAQVKGKDEFYKSPVDGNEYNISNMLAFNLAKKLVFRLEYAGESKDFTKEWLNYMQA

SEQ ID NO: 205 - protein, 1247 aa, Butyrivibrio hungatei
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLEGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVKNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNKEHDNTAIILRKNGLYYLAIMKKSANKIFDKDKLDNSGDCYEKMVYKLLPGANKMLPKVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVVDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSDRFKFSPITNKDWLVFAQEKPYLND

SEQ ID NO: 206 - protein, 973 aa, Butyrivibrio hungatei
MTEEDTKSFVDEILLTPESVIKTIDNFIDSIIMNDIEGLKEEFLKISLENFEGIYISNKKLNEISNRKFGDYNSINMMIKQSMNEKGILSKKEINELIPDLENINKPKVKSFNLSFIFENLTKEHKELIIDYIRENICNVIENVKITIEKYRNIDNKIEFKNNAEKVSKIKEMLESINELCKLIKEFNTDEIEKNNEFYNILNKNFEIFESSYKVLNKVRNFVTKKEVIENKMKLNFSNYQLGNGWHKNKEKDCSIILFRKRNNERWIYYLGILKHGTKIKENDYLSSVDTGFYKMDYYAQNSLSKMIPKCSITVKNVKNAPEDESVILNDSKKFNEPLEITPEIRKLYGNNEHIKGDKFKKESLVKWIDFCKEFLLKYKSFEKAKKEILKLKESNLYENLEEFYSDAEEKAYFLEFINIDEDKIKKLVKEKNLYLFQIYNKDFSAYSTGNKNLHTMYFEELFTDENLKKPVFKLNGNTEVFYRIASSKPKIVHNKGEKLVNKTYLDDGIIKTIPDSVYEEISEKVKNNEDYSKLLEENNIKNLEIKVATHEIVKDKRYFENKFLFYLPITLNKKVSNKNTNKNINKNVIDEIKDCNEYNVIGIDRGERNLISLCIINQNGEIILQKEMNIIQSSDKYNVDYNEKLEIKSKERDNAKKNWSEIGKIKDLKSGYLSAVVHEIVKLAIEYNAVIILEDLNNGFKNSRKKVDKQIYQKFERALIEKLQFLIFKNYDKNEKGGLRNAFQLTPELKNITKVASQQGIIIYTNPAYTSKIDPTTGYANIIKKSNNNEESIVKAIDKISYDKEKDMFYFDINLSNSSFNLTVKNVLKKEWRIYTNGERIIYKDRKYITLNITQEMKDILSKCGIDYLNIDNLKQDILKNKLHKKVYYIFELANKMRNENKDVDYIISPVLNKDGKFFMTQEINELTPKDADLNGAYNIALKGKLMIDNLNKKEKFVFLSNEDWLNFIQGR

SEQ ID NO: 207 - protein, 1300 aa, Butyrivibrio hungatei; identical to SEQ ID NO: 136

SEQ ID NO: 208 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 209 - protein, 1238 aa, Unknown
  Candidatus Methanoplasma termitum strain MpT1
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 210 - protein, 1251 aa, Moraxella bovoculi; identical to SEQ ID NO: 111

SEQ ID NO: 211 - protein, 1069 aa, Francisella hispaniensis
MSIYQGFVNKYNLSKTLRFELIPQGKTRENIKIKGLILDDEKRAKDYKKAKQIIDKYHQFFIEEILSSVCIGEDLLQNYSNIYFKLKKTDDDNLQKEFKNAKDTIKKQISKHINDSERFKNLFNQNLIDAKKGQESDLILWLKQSKDNGIELFKANNDITDIDEALEIIKSFKGWTTYFKGFHDNRKNVYSTDDIPTSIIYRIVDDNLPKFLENKAKYESLKDKAPEAINYEQIKKDLAEELTFDIDYKTSEVNQRVFSLDEVFEIANFNNYLNQSGISKFNTVIGGKFVNGESAKRKGINEYINLYSQQTNDKTLKKFKMSVLFKQILSDTESKSFVIDKLEDDSDVVTTIQSFYEQIAAFKIVEEKSIKETLSLLFDDLKAQKLDLSKVYFKNDKSLTDLSQQVFDDYSVISTAVLEYITQQVAPKNVDNPTKKEQELIAKKTQKAKYLSLETIRDALNEFNKHRDIDKQCQFEKILANFADIPRLLDEITQHKGNLAHIFVKYQNQDKKDLLQTSAEGDVKAIKELLDQTNNLLHKLKIFHITQSEDKANILDKDEHFYLVFEECYFELANIVPIYNKVRNYITQKPYSDEKFKLNFDNSTLANGWDKNKESDNTAILFIKDDKYYLGVMDKKNNKIFNDKAIKENKGEDYKKVVYKLLPGANKMLPKVFFSAKSVNYYNPDKEILRIRNHSTHTKNGSPQKGYEKFEFNIEDCRKFIDFYKQSISRHPEWKDFGFRFSDTKKYNSIDEFYREVENQGYKLTFENISKSYIDSLVNEGKLYLFQIYNKDFSAYSKGRPNLHTLYWKALFDERNLQDVVYKLNGEAELFYRKQSIPKKITHPAKEVIANKNKDNPKKESVFEYDLIKDKRFTEDKFFFHCPITMNFKSSGANKFNDEINLLLKEKANDVHILSIDRGERHLAYYTLVDGKGNIIKQDTFNIIGNDRMKTNYHDKLTAIEKDRDSARKDWKKINNIKEMKEGYLSQVVHEIATLVIDYNAIVIFEDLNFGFKRGRFKVEKQVYQKLEKMLIEKLNYLVFKDNEFDKAGGVLRAYQLTSPFETFKKMGK

SEQ ID NO: 212 - protein, 1463 aa, Saccharobesus litoralis
MSDRLDVLTNQYPLSKTLRFELKPVGATADWIRKHNVIRYHNGKLVGKDAIRFQNYKYLKKMLDEMHRLFLQQALVLEPNSNQAQELTALLRAIENNYCNNNDLLAGDYPSLSTDKTIKISNGLSKLTTDLFDKKFEDWAYQYKEDMPNFWRQDIAELEQKLQVSANAKDQKFYKGIIKKLKNKIQKSELKAETHKGLYSPTESLQLLEWLVRRGDIKLTYLEIGKENEKLNELVPLVELKDIHRNFNNFATYLSGFSKNRENVYSTKFDRRSGYKATSVIARTFEQNLMFCLGNIAKWHKVTEFINQANNYELLQEHGIDWNKQIAALEHKLDVCLAEFFALNNFSQTLAQQGIEKYNQVLAGIAEIAGQPKTQGLNELINLARQKLSAKRSQLPTLQLLYKQILSKGDKPFIDDFKSDQELIAELNEFVSSQIHGEHGAIKLINHELESFINEARAAQQQIYVPKDKLTELSLLLTGSWQAINQWRYKLFDQKQLDKQQKQYSFSLAQVERWLATEVEQQNFYQTEKERQQHKDTQPANVTTSSDGHSILTAFEQQVQTLLTNICVAAEKYRQLSDNLTAIDKQRESESSKGFEQIAVIKTLLDACNELNHFLARFTVNKKDKLPEDRAEFWYEKLQAYIDAFPIYELYNKVRNYLSKKPFSTEKVKINFDNSHFLSGWTADYERHSALLFKFNENYLLGVVNENLSSEEEEKLKLVGGEEHAKRFIYDFQKIDNSNPPRVFIRSKGSSFAPAVEKYQLPIGDIIDIYDQGKFKTEHKKKNEAEFKDSLVRLIDYFKLGFSRHDSYKHYPFKWKASHQYSDIAEFYAHTASFCYTLKEENINFNVLRELSSAGKVYLFEIYNKDFSKNKRGQGRDNLHTSYWKLLFSAENLKDVVLKLNGQAEIFYRPASLAETKAYTHKKGEVLKHKAYSKVWEALDSPIGTRLSWDDALKIPSITEKTNHNNQRVVQYNGQEIGRKAEFAIIKNRRYSVDKFLFHCPITLNFKANGQDNINARVNQFLANNKKINIIGIDRGEKHLLYISVINQQGEVLHQESFNTITNSYQTANGEKRQVVTDYHQKLDMSEDKRDKARKSWSTIENIKELKAGYLSHVVHRLAQLIIEFNAIVALEDLNHGFKRGRFKIEKQVYQKFEKALIDKLSYLAFKDRTSCLETGHYLNAFQLTSKFKGFNNLGKQSGILFYVNADYTSTTDPLTGYIKNVYKTYSSVKDSTEFWQRFNSIRYIASENRFEFSYDLADLKQKSLESKTKQTPLAKTQWTVSSHVTRSYYNQQTKQHELFEVTARIQQLLSKAEISYQHQNDLIPALASCQSKALHKELIWLFNSILTMRVTDSSKPSATSENDFILSPVAPYFDSRNLNKQLPENGDANGAYNIARKGIMLLERIGDFVPEGNKKYPDLLIRNNDWQNFVQRPEMVNKQKKKLVKLKTEYSNGSLFNDLAFK

SEQ ID NO: 213 - protein, 1369 aa, Treponema rectale
MEKTMDDFTNLYSLSKTLRFELKPIAETKENIEKGKFLESDKKKAADYKAVKKIIDNYHKYFIDDVLKNASFTWTKLEEAIKEYNKNRNDDSVVENEQKKLREEILKLFTSDKRYKALTAATPKDLFDTILPEWFGENSNPDLNKTALKTFQKFTSYFTGFQENRKNVYSAEPIPTAVPYRIVNDNFPKFLQNISIFKTIQEKCPQVIDDVEKELSSYLGKEKLADIFTLESFNKYLGQGGKENQRGIDFYNQIIGGIAEKEGEQNLRGINQFLNLYWQQNPEFAKENRRIKMVPLYKQILSDRSSLSFKIESIENDEELKIALLECADKLEGKNEEKKSVFEDTCDLFESLKNQNLQEIYINRKDIKTVSRILTGDWSWLQTRMNVYAEEKFTTKAEKARWQKSLDDEGENKSKGFYSLAELNKVLEYSSENVTETDIRITDYFEHRCRYYIEKESERFVQGSELIALSIKEMCDDIQTKRKGMDRVLENLSDEKLLKEKTEDIAVIKNYLVAVQNLLHRIKPLKVNGVGDSSFYAIYDSIYSALSEVISVYNKTRNYITKKAASPEKYKLNFDNPTLADGWDLNKEQANTSVLLRKDGMYYLGIMNPKNKPKFAEKYEVADGQSCYEKMIYKQFDATKQIPKCSTQKKEVQKYFLSGATEPYILNDKKSFKSELIITKDIWFMNNHVWNGEKFVPKRDNETRPKKFQIGYFKQTGDFDGYKNALSKWISFCKEFLQSYISSTVYDYNFKKSDEYEGLDDFYNYLNATCYKLTFINIPESEIEKMVSEGKLYLFQIYNKDFAPGANGRPNMHTLYWKNLFSDENLKNVCLKLNGEAELFYRPAGIKDPVVHKEGSYLVNRTTEDGESIPEKIYLEIYKNANGKLDSLSDEAKSYKENHKIVIKKASHEIIKDRHYTEAKFLFHVPITINFKASGNSFSINENVRRFLKNNPDVNIIGLDRGERHLIYLSLINQKGEILKQFTFNEVERDKNGQTVKVNYHEKLDQREKERDSARKSWQTVGKIAELKEGYLSAVIHQLTKLMVEYNAIVVMEDLNFGFKRGRFHVEKQVYQKFEHMLIDKLNYLVFKDRGLNEPSGVLNGYQLTGQFESFQKLGKQSGMLFYVPAGYTSKIDPKTGFVSMMNFKDLTNVHKKRNFFSNFNDIHFDDATGSFVFTFDYKNYDGKAKEEMKQTKWSVYSRDKRIVYFPKVKSYEDIQPTEKLKALFETAGIDYKSGNPILDSIMTIGADLKEGAKPSKEIAEFWDGLLYNFKLILQMRNSNARTGEDYIISPVMADTGTFFDSREELKKGEDAKLPLDADANGAYHIALKGLELINKINLTDENELKKMKISISNADWFQFAQEKNYAKG

SEQ ID NO: 214 - protein, 1278 aa, Ruminococcus bovis
MSININKFSDECRKIDFFTDLYNIQKTLRFSLIPIGATADNFEFKGRLSKEKDLLDSAKRIKEYISKYLADESDICLSQPVKLKHLDEYYELYITKDRDEQKFKSVEEKLRKELADLLKEILKRLNKKILSDYLPEYLEDDEKALEDIANLSSFSTYFNSYYDNCKNMYTDKEQSTAIPYRCINDNLPKFIDNMKAYEKALEELKPSDLEELRNNFKGVYDTTVDDMFTLDYFNCVLSQSGIDSYNAIIGNDKVKGINEYINLHNQTAEQGHKVPNLKRLYKQIGSQKKTISFLPSKFESDNELLKAVYDFYNTGDAEKNFTALKDTITEFEKIFDNLSEYNLDGVFVRNDISLTNLSQSMFNDWSVFRNLWNDQYDKVNNPEKAKDIDKYNDKRHKVYKKSESFSINQLQELIATTLEEDINSKKITDYFSCDFHRVTTEVENKYQLVKDLLSSDYPKNKNLKTSEEDVALIKDFLDSVKSLESFVKILTGTGKESGKDELFYGSFTKWFDQLRYIDKLYDKVRNYITEKPYSLDKIKLSFDNPQFLGGWQHSKETDYSAQLFMKDGLYYLGVMDKETKREFKTQYNTPENDSDTMVKIEYNQIPNPGRVIQNLMLVDGKIVKKNGRKNADGVNAVLEELKNQYLPENINRIRKTESYKTTSNNFNKDDLKAYLEYYIARTKEYYCKYNFVFKSADEYGSFNEFVDDVNNQAYQITKVKVSEKQLLSLVEQGKLYLFKIYNKDFSEYSKGKKNLHTMYFQMLFDDRNLENLVYKLQGGAEMFYRPASIKKDSEFKHDANVEIIKRTCEDKVNDKDNPTDDEKAKYYSKFDYDIVKNKRFTKDQFSLHLTLAMNCNQPDHYWLNNDVRELLKKSNKNHIIGIDRGERNLIYVTIINSDGVIVDQINFNIIENSYNGKKYKTDYQKKLNQREEDRQKARKTWKTIETIKELKDGYISQVVHQICKLIVQYDAIVVMENLNGGFKRGRTKVEKQVYQKFETMLINKLNYYVDKGTDYKECGGLLKAYQLTNKFETFERIGKQSGIIFYVDPYLTSKIDPVTGFANLLYPKYETIPKTHNFISNIDDIRYNQSEDYFEFDIDYDKFPQGSYNYRKKWTICSYGNRIKYYKDSRNKTASVVVDITEKFKETFTNAGIDFVNDNIKEKLLLVNSKELLKSFMDTLKLTVQLRNSEINSDVDYIISPIKDRNGNFYYSENYKKSNNEVPSQPQDGDANGAYNIARKGLMIINKLKKADDVTNNELLKISKKEWLEFAQKGDLGE

SEQ ID NO: 215 - protein, 1205 aa, Pseudobutyrivibrio xylanivorans
MYYQGLTKLYPISKTIRNELIPVGKTLEHIRMNNILEADIQRKSDYERVKKLMDDYHKQLINESLQDVHLSYVEEAADLYLNASKDKDIVDKFSKCQDKLRKEIVNLLKSHENFPKIGNKEIIKLLQSLSDTEKDYNALDSFSKFYTYFTSYNEVRKNLYSDEEKSSTAAYRLINENLPKFLDNIKAYSIAKSAGVRAKELTEEEQDCLFMTETFERTLTQDGIDNYNELIGKLNFAINLYNQQNNKLKGFRKVPKMKELYKQILSEREASFVDEFVDDEALLTNVESFSAHIKEFLESDSLSRFAEVLEESGGEMVYIKNDTSKTTFSNIVFGSWNVIDERLAEEYDSANSKKKKDEKYYDKRHKELKKNKSYSVEKIVSLSTETEDVIGKYIEKLQADIIAIKETREVFEKVVLKEHDKNKSLRKNTKAIEAIKSFLDTIKDFERDIKLISGSEHEMEKNLAVYAEQENILSSIRNVDSLYNMSRNYLTQKPFSTEKFKLNFNRATLLNGWDKNKETDNLGILLVKEGKYYLGIMNTKANKSFVNPPKPKTDNVYHKVNYKLLPGPNKMLPKVFFAKSNLEYYKPSEDLLAKYQAGTHKKGENFSLEDCHSLISFFKDSLEKHPDWSEFGFKFSDTKKYDDLSGFYREVEKQGYKITYTDIDVEYIDSLVEKDELYLFQIYNKDFSPYSKGNYNLHTLYLTMLFDERNLRNVVYKLNGEAEVFYRPASIGKDELIIHKSGEEIKNKNPKRAIDKPTSTFEYDIVKDRRYTKDKFMLHIPVTMNFGVDETRRFNEVVNDAIRGDDKVRVIGIDRGERNLLYVVVVDSDGTILEQISLNSIINNEYSIETDYHKLLDEKEGDRDRARKNWTTIENIKELKEGYLSQVVNVIAKLVLKYDAIICLEDLNFGFKRGRQKVEKQVYQKFEKMLIDKLNYLVIDKSRSQENPEEVGHVLNALQLTSKFTSFKELGKQTGIIYYVPAYLTSKIDPTTGFANLFYVKYESVEKSKDFFNRFDSICFNKVAGYFEFSFDYKNFTDRACGMRSKWKVCTNGERIIKYRNEEKNSSFDDKVIVLTEEFKKLFNEYGIAFNDCMDLTDAINAIDDASFFRKLTKLFQQTLQMRNSSADGSRDYIISPVENDNGEFFNSEKCDKSKPKDADANGAFNIARKGLWVLEQLYNSSSGEKLNLAMTNAEWLEYAQQHTI

SEQ ID NO: 216 - protein, 1312 aa, Helcococcus kunzii
MFEKLSNIVSISKTIRFKLIPVGKTLENIEKLGKLEKDFERSDFYPILKNISDDYYRQYIKEKLSDLNLDWQKLYDAHELLDSSKKESQKNLEMIQAQYRKVLFNILSGELDKSGEKNSKDLIKNNKALYGKLFKKQFILEVLPDFVNNNDSYSEEDLEGLNLYSKFTTRLKNFWETRKNVFTDKDIVTAIPFRAVNENFGFYYDNIKIFNKNIEYLENKIPNLENELKEADILDDNRSVKDYFTPNGFNYVITQDGIDVYQAIRGGFTKENGEKVQGINEILNLTQQQLRRKPETKNVKLGVLTKLRKQILEYSESTSFLIDQIEDDNDLVDRINKFNVSFFESTEVSPSLFEQIERLYNALKSIKKEEVYIDARNTQKFSQMLFGQWDVIRRGYTVKITEGSKEEKKKYKEYLELDETSKAKRYLNIREIEELVNLVEGFEEVDVFSVLLEKFKMNNIERTEFEAPIYGSPIKLEAIKEYLEKHLEEYHKWKLLLIGNDDLDTDETFYPLLNEVISDYYIIPLYNLIRNYLTRKHSDKDKIKVNFDFPTLADGWSESKISDNRSIILRKDGYYYLGILEDNKLFNNIKSNSLKNYYEIMRYNLFPDAAKMIPKCSISKKEVKNHFENGVDKSIYLDNQFVSPLEISKELYELQNNLVDGKKKYQIDYLRNTDDEVGYKNALVQWITFCKDFLLKYQGTQDFDYSELKEAKYYDKLDQFYADVDSCGYNLDFDNIDEDLVNKAVEDGKLLIFQIYNKDFSPESKGKKNLHTLYWLSMFSEENLRTRKLKLNGQAEIFYRKKLEKKPIIHKEGSILLNKIDKEGNTIPENIYHECYRYLNKKIGREDLSDEAIALFNKDVLKYKEARFDIIKDRRYSESQFFFHVPITFNWDIKTNKNVNQIVQGMIKDGEIKHIIGIDRGERHLLYYSVIDLEGNIVEQGSLNTLEQNRFDNSTVKVDYQNKLRTREEDRDRARKNWTNINKIKELKDGYLSHVVHKLSRLIIKYEAIVIMENLNQGFKRGRFKVERQVYQKFELALMNKLSALSFKEKYDEGKNLEPSGILNPIQACYPVDAYQELQGQNGIVFYLPAAYTSVIDPVTGFTNLFRLKSINSSKYEEFIKKFKNIYFDNEEEDFKFIFNYKDFAKANLVILNNIKSKDWKISTRGERISYNSKKKEYFYVQPTEFLINKLKELNIDYENIDIIPLIDNLEEKAKRKILKALFDTFKYSVQLRNYDFENDYIISPTADDNGNYYNSNEIDIDKTNLPNNGDANGAFNIARKGLLLKDRIVNSNESKVDLKIKNEDWINFIIS

SEQ ID NO: 217 - protein, 1282 aa, Lachnospira eligens; identical to SEQ ID NO: 208

SEQ ID NO: 218 - protein, 1347 aa, Unknown
  candidate division WWE3 bacterium CG22
MASSHFISLDNSFSKFTNLYSLSKTLRFELVPTENTTVMLENNNVFKKDQIIQVKYEKTKPFIDRLHREFIKEALSNYAVSGLQEYFEILRAGGKKANLDSAKKQLRKHVVDQFNATASLWVSRHKDVGFKGEGIELLFKEAVFKLLKEKYGTDMNALIEDNHGKQISIFDSWKGFTGYFDKFQQTRRNLYKDDGKEGRVATRIIDQNLTRFCDNIFVYEKIKDKVSFIDVEKSFGKTCSEVFIPDYYNTCLLQDGIDSYNEFIGGKPLENGEKVQGLNELINLYRQTTGDKVPYFKKLEKQILGEKDEVFIDEITDEDFVPRVLAFYRTVDAKYKLFLKLLDDFVTNQDVYELSQIYISKKGLQEKLYRWLTPSAREVYDEELFEVLKKAKKVNNKDKQKVSGYVPDFVEVLYIKQALENIDAKLIWSDRYYSDGENEGIIDKGFSSWKQFLVILNHEYRQLLSFEDHVIIDKELDFDKEVKQLTDTVEIVSQDKNARTVTYRGGYDVYKAKLAELGQSFEKDTCTKKVIKNFADSVLSMYHFAMMFAVWDDTYPLDVFYTNNEFGYLLYYEDAYKNIVQEYNKLRNYLTKKPYSTEKWKLNFENPTLAAGFDKNKESDNSTVILRQGDKYFLGVMKKGFNKIFDNSQISQTGNSPEAYFEKMVYKYTKDVVTGIPKSSTQVKEVQEHFRNSDEDFFLEECSSVGNFIVPLKITKEIFDLNNKVYAKEDISQAMYRWALNTDEEKNYVKSFQKSYLSLGGSPELYCKSVTLWIGFCLNFLKSYPSAAYFDYSQLRQASDYESVDECYQELNNAGYTILFQNVSEKYVRVKNKNGELYLFQIKNKDWNEGSTGKKNLHTLYFESLFSKENAKQGFPFKLSGNAELFFRPGSIEQTYERRNFPREIPLKRRYSKDGIFFHIPVQVNRTKVGSPNQFNKEVNDFLAGNPNINIIGVDRGEKHLVYYSVISQNGEKIDGGSFNEINGQDYHDKLEKRAKEREQQRRDWETVEGIKDLKKGYISQVVKKLADLAIEHNAIIVMEDLNMRFKQIRGGIEKSVYQQLEKALIDKLSFLVNKGEVDPQKAGHLLKAYQLTAPIDAFKDMGKQTGIMFYTQAAYTSKIDPVTGWRPHLYLKYSSVEKAKDDISRFTKIAYKNDRFEFTYNITDFRTQKEWPLKTEWTVCSCVERFRWNKKLANGKGDYEHYPNVTDDFKKLFDSVGINYLQENIKSQVVNLDENTNVEFFREFIKLFALVCQIRNTNSEEAGNLNDFILSPVEPFFDSRSAEDFGKGLPSNGDENGAYNIARKGMIILNTLSTFKNDHGSCEGLSWGDLYISDTQWDDFAQSFHG

SEQ ID NO: 219 - protein, 1132 aa, Unknown
  Patescibacteria group bacterium
MEVKNTSFEQFTDQYSLSKTLRFELRPVGETPKMLEENNVFGKDKNIQKKYEQTKPFFDRLHRDFVKDALTNVQLDGLREYFEIWKMWQADSKNKDKKKKLENKEKQLRKNIVGLFDDTAKKWLEKYSNVQIKKKDRDFLFEENIFSLLQELYGKEEDAFLKDEKGEYIVVEKDEKKEKISLFEDWKGFVGYFGKFFETRKNFYKDDGTASAIATRIVDQNLRRFCNNLLESDKANKKVDFLEVESTFNIEMKDIFSIEYYSNCLSQEGIDAYNRILGADSKTQGMEGINQYINKYRQKNKGEQVNFLKGLDKQILSEKMKFIDEIESDEGLEIILNELKENVDKKVKMFKKLFFDFVDHNDSYDLSKIYFSKESLNTILYRWFSEPQLIQEKLFEVLNKKDVKAWYEARKISSKDSSLKKDDDGTFSFPSFVQLAHIREALENIGKDVRVWKENYYKEDDNKKQKAILTQGELIWDEFLAVFKIEFQTLFEQVIEKEGKKEIIAYDVYFEQFEHLLNNFQNNDTAKEIIKLFLDSALSIYQMAKYFAVEKKRNWIEKYEIDDNFYDHIEYGYKKFYDGSYDEFILPYNKVRNYLTKKPYSEEKWKLNFENSTLADGWDKNKESDNSAVLLKKDSQYFLALMKKGNNKIFDDKNNQYFIKDIEKGKYEKVTYKLLPGANKMLPKVFFSKKSIDFFAPSERVLDIRNHSSHSKNGNPQKGFEKKDFNLQDCYEIIDFFKDSLSKHEEWNQFDFIFSDTGKYKDISDFYREVSAQGYKISFQDISEKYIQEKNEAGELYLFQIKNKDWNEGSKGKKNLQTLYFESLFSQENMQNNFSMKLNGQAEIFYRPKTDDKKLGKKLDKSGKEIVNHKRYSENKILFHVPITINRTSGDTNQYRFNQEVNNFLAQNKDINIIGIDRGEKHLAYYSVIDQNGKIIYQDTLNIVNGIDYAQKLEEVAKGREQARKDWKTVEGIKNLKQGYISQVVHEITDLAIKHNAIIVLEDLNMRFKQIRGGIEKSVYQQLEKALIDKLSFLVKKGEKDPEKAGNLLRAYQLAAPFESFQKMGKQTGIIFYTQASYTSKTCPNCGFRPNLRFKYNSIDKSKELLKKLDNFFIFSRKKCFCNRLFCFSILE

SEQ ID NO: 220 - protein, 871 aa, Unknown
  Prevotella sp. P4-98
MKAINEYYKQLGAYCREEGKEKDDFFKRIDGAYCAISHLFFGEHGEIAQSDSDVELIQKLLEAYKGLQRFIKPLLGHGDEADKDNEFDAKLRKVWDELDIITPLYDKVRNWLSRKIYNPEKIKLCFENNGKLLSGWVDSRTKSDNGTQYGGYIFRKKNEIGEYDFYLGISADTKLFRRDAAISYDDGMYERLDYYQLKSKTLLGNSYVGDYGLDSMNLLSAFKNAAVKFQFEKEVVPKDKENVPKYLKRLKLDYAGFYQILMNDDKVVDAYKIMKQHILATLTSSIRVPAAIELATQKELGIDELIDEIMNLPSKSFGYFPIVTAAIEEANKRENKPLFLFKMSNKDLSYAATASKGLRKGRGTENLHSMYLKALLGMTQSVFDIGSGMVFFRHQTKGLAETTARHKANEFVANKNKLNDKKKSIFGYEIVKNKRFTVDKYLFKLSMNLNYSQPNNNKIDVNSKVREIISNGGIKNIIGIDRGERNLLYLSLIDLKGNIVMQKSLNILKDDHNAKETDYKGLLTEREGENKEARRNWKKIANIKDLKRGYLSQVVHIISKMMVEYNAIVVLEDLNPGFIRGRQKIERNVYEQFERMLIDKLNFYVDKHKGANETGGLLHALQLTSEFKNFKKSEHQNGCLFYIPAWNTSKIDPATGFVNLFNTKYTNAVEAQEFFSKFDEIRYNEEKDWFEFEFDYDKFTQKAHGTRTKWTLCTYGMRLRSFKNSAKQYNWDSEVVALTEEFKRILGEAGIDIHENLKDAICNLEGKSQKYLEPLMQFMKLLLQLRNSKAGTDEDYILSPVADENGIFYDSRSCGDQLPENADANGAYNIARKGLMLIEQIKNAEDLNNVKFDISNKAWLNFAQQKPYKNG

SEQ ID NO: 221 - protein, 1320 aa, Unknown
  bacterial
MQQYQVSKTVRFGLTLKNSEKKHATHLLLKDLVNVSEERIKNEITKDDKNQSELSFFNEVIETLDLMDKYIKDWENCFYRTDQIQLTKEYYKVIAKKACFDWFWTNDRGMKFPTSSIISFNSLKSSDKSKTSDNLDRKKKILDYWKGNIFKTQKAIKDVLDITEDIQKAIEEKKSHREINRVNHRKMGIHLIHLINDTLVPLCNGSIFFGNISKLDFCESENEKLIDFASTEKQDERKFLLSKINEIKQYFEDNGGNVPFARATLNRHTANQKPDRYNEEIKKLVNELGVNSLVRSLKSKTIEEIKTHFEFENKNKINELKNSFVLSIVEKIQLFKYKTIPASVRFLLADYFEEQKLSTKEEALTIFEEIGKPQNIGFDYIQLKEKDNFTLKKYPLKQAFDYAWENLARLDQNPKANQFSVDECKRFFKEVFSMEMDNINFKTYALLLALKEKTTAFDKKGEGAAKNKSEIIEQIKGVFEELDQPFKIIANTLREEVIKKEDELNVLKRQYRETDRKIKTLQNEIKKIKNQIKNLENSKKYSFPEIIKWIDLTEQEQLLDKNKQAKSNYQKAKGDLGLIRGSQKTSINDYFYLTDKVYRKLAQDFGKKMADLREKLLDKNDVNKIKYLSYIVKDNQGYQYTLLKPLEDKNAEIIELKSEPNGDLKLFEIKSLTSKTLNKFIKNKGAYKEFHSAEFEHKKIKEDWKNYKYNSDFIVKLKKCLSHSDMANTQNWKAFGWDLDKCKSYETIEKEIDQKSYQLVEIKLSKTTIEKWVKENNYLLLPIVNQDITAEKLKVNTNQFTKDWQHIFEKNPNHRLHPEFNIAYRQPTKDYAKEGEKRYSRFQLTGQFMYEYIPQDANYISRKEQITLFNDKEEQKIQVETFNNQIAKILNAEDFYVIGIDRGITQLATLCVLNKNGVIQGGFEIFTREFDYTNKQWKHTKLKENRNILDISNLKVETTVNGEKVLVDLSEVKTYLRDENGEPMKNEKGVILTKDNLQKIKLKQLAYDRKLQYKMQHEPELVLSFLDRLENKEQIPNLLASTKLISAYKEGTAYADIDIEQFWNILQTFQTIVDKFGGIENAKKTMEFRQYTELDASFDLKNGVVANMVGVVKFIMEKYNYKTFIALEDLTFAFGQSIDGINGERLRSTKEDKEVDFKEQENSTLAGLGTYHFFEMQLLKKLSKTQIGNEIKHFVPAFRSTENYEKIVRKDKNVKAKIVSYPFGIVSFVNPRNTSISCPNCKNANKSNRIKKENDRILCKHNIEKTKGNCGFDTANFDENKLRAENKGKNFKYISSGDANAAYNIAVKLLEDKIFEINKK

SEQ ID NO: 222 - protein, 1320 aa, Unknown; identical to SEQ ID NO: 221
  bacterial

SEQ ID NO: 223 - RNA, 66 nt, Butyrivibrio hungatei
gggaguucaaaaauugcaaaccuccgucuuaauuucuaugcccgacgugaaaaaggcuuuuagaug

SEQ ID NO: 224 - RNA, 72 nt, Butyrivibrio hungatei
aagaagcugacggggagauaaaaacucaaaaauaauuauccacaaaaugcuuauauaucaguacuuuuuuau

SEQ ID NO: 225 - RNA, 74 nt, Butyrivibrio hungatei
uaugugcuauaauauauuagugcuuucaaaauuguaaaucaagguguuaauauuuuuaaaaugcgaaaaaauca

SEQ ID NO: 226 - RNA, 80 nt, Butyrivibrio hungatei
uaaaaauaugacuguuguuauauaucaaaaugcuaaaaaaaucauagauuuuaggucuuuuuuugcugauuuaggcaaaa

SEQ ID NO: 227 - RNA, 89 nt, Eubacterium eligens
ugcaaacaugggcuuugauaaauuauuauuuaaagguuauucaauaaaauaugaaaaaauacacaaauaaauuguuuuuuaagguuaua

SEQ ID NO: 228 - RNA, 87 nt, Unknown
  Candidatus Methanoplasma termitum strain MpT1
uggguuaugcgauacaugaggaaucagacauuguaaucgucugaugcaaaccccggucuuaauuuuucauuucgucaguuuucaaau

SEQ ID NO: 229 - RNA, 95 nt, Moraxella bovoculi
agagagcuaaagcacgcucaaauauuuacuuugcaaaccucagucuuaaugcgugauuuaucauguuuugucgguaaaaaugauuauuuuuugug

SEQ ID NO: 230 - RNA, 95 nt, Francisella hispaniensis
guucuuagagauauuuaaaaauaugacuguuguuauauaccaaaaugcuaaaaagaugauagauuuuaggucuuuuuuugcucauuuaggcaaaa

SEQ ID NO: 231 - RNA, 94 nt, Saccharobesus litoralis
agucuuaauggcuaauuagguuaaaaaugaugaauguaagguuagaaaacacagauaaauugauagaaaaacgcgcuguugcccgcuuuuugac

SEQ ID NO: 232 - RNA, 80 nt, Treponema rectale
accuuaggucuuacuggagaauuugaugaaaaaauugcuuuuuuuaucaauuuuggccgcauuauaugcgauaaacagca

SEQ ID NO: 233 - RNA, 80 nt, Ruminococcus bovis
aaccucagucuuuauuuuagauauucuuugaaaaagguuguuaaacaaugaagauuauaugcacaaugaacaauugcaua

SEQ ID NO: 234 - RNA, 85 nt, Pseudobutyrivibrio xylanivorans
ugucagauaugguuaugcuaaaaauguggaaaaggaucuagucaugauaacauaauugcaaaccuguaauugaauuuugauauua

SEQ ID NO: 235 - RNA, 80 nt, Helcococcus kunzii
ucuuaaaggauaucuaaaaauguauucauuaaaugagaguuuaugcauugcaauacuaacuauagugacauucggagcgc

SEQ ID NO: 236 - RNA, 80 nt, Lachnospira eligens
uuauuacauaaugcaaacaugggcuuugauaaauuauuauuuaaagguuauucaauaaaauaugaaaaaauacacaaaua

SEQ ID NO: 237 - RNA, 93 nt, Unknown
  candidate division WWE3 bacterium CG22
gaaugaguguagauuugcggacauuuauaauauggugaaagaggaaaucacucuguaacggaauaguaaaaccuuaguguuaaugauuuuugc

SEQ ID NO: 238 - RNA, 90 nt, Unknown
  Patescibacteria group bacterium
caauaugcaaagcuugcgaagaaaaaauaguucguuauggauaugcaaagaaugaagaagacgaagugauaaugauuugauuuuugauca

SEQ ID NO: 239 - RNA, 94 nt, Unknown
  Prevotella sp. P4-98
gaguacaaaccucugucuauauguaauugcgaaauaugauacaucuuguuauaacacaaucaguugcgcaaucugcgaagugcgauuuuuguug

SEQ ID NO: 240 - RNA, 89 nt, Unknown
  bacterial
aguuacuauuguaacaauugcaaaccuaggucuuaauauucuauaauaugacaaaaagcauaaaaacaagccaagaagcauuguuuuuu

SEQ ID NO: 241 - RNA, 70 nt, Unknown
  bacterial
uuuuaugcuuuuugucauauuauagaauauuaagaccuagguuugcaauuguuacaauaguaacuuuuuu

SEQ ID NO: 242 - DNA, 100 bp, Unknown
  Lachnospiraceae bacterium ND2006
gtttcaaagattaaataatttctactaagtgtagatcggtctcgcaaagaatggatatactcatgtttcaaagattaaataatttctactaagtgtagat

SEQ ID NO: 243 - DNA, 96 bp, Unknown
  Acidaminococcus sp. BV3L6
gtcaaaagacctttttaatttctactcttgtagatgtctaaactggtcgaaatcgaccagtgtcaaaagacctttttaatttctactcttgtagat

What is claimed:

1. An engineered system comprising:
   (a) a Cas12a nuclease, or one or more nucleotide sequences encoding the Cas12a nuclease; and
   (b) at least one engineered Cas12a crRNA designed to form a complex with the Cas12a nuclease and comprising at least one direct repeat or fragment thereof and a spacer sequence designed to hybridize with a target sequence in a eukaryotic cell, or one or more nucleotide sequences encoding the at least one engineered Cas12a crRNA polynucleotide; and
   (c) a Cas12a tracrRNA comprising a sequence selected from the group consisting of SEQ ID NOs: 1, 3, 6, 139-146, 149-169, 223-225 and 227-239.

2. The engineered system of claim 1, wherein the Cas12a nuclease is:
   (a) a Cas 12a nuclease identified from the genome of a bacterial species selected from the group consisting of *Francisella tularensis* 1, *Prevotella albensis, Lachnospiraceae bacterium* MC2017 1, *Butyrivibrio proteoclasticus*, Peregrinibacteria bacterium GW2011 GWA2 33 10, Parcubacteria bacterium GW2011 GWC2 44 17, Smithella sp. SCADC, *Acidaminococcus* sp. BV3L6, *Lachnospiraceae bacterium* MA2020, *Candidatus Methanoplasma termitum, Eubacterium eligens, Moraxella* bovoculi 237, *Leptospira inadai, Lachnospiraceae bacterium* ND2006, *Porphyromonas* crevioricanis 3, *Prevotella disiens* and *Porphyromonas macacae*; or
   (b) a Cas12a nuclease selected from the group consisting of LbCas12a, AsCas12a, FnCas12a, and a deactivated Cas12a nuclease; or
   (c) a Cas12a nuclease having at least 80% sequence identity with a sequence selected from the group consisting of SEQ ID NOs: 11, 107-138, 172, 204-221, and 222; or
   (d) a Cas12a nuclease variant selected from the group consisting of (1) a variant LbCpf1 that differs from a wild-type LbCpf1 sequence (SEQ ID NO:135) in containing at least one point mutation selected from the group consisting of G309P, Y312F, M474I, D523N, Q531K, C930A, D937N, V954F/Q, M975L, A984E, I994L, T1006K, I1014V, V1055N/D, L1065F/Y, Y1180F, V1209G, I1229L, V801I, Y802I, D850A, E943A, and D1198A; (2) a variant AsCpf1 that differs from a wild-type AsCpf1 sequence (SEQ ID NO: 134) in containing at least one point mutation selected from the group consisting of L320P, V980A, Q987N, T1004F/Q, K1035E, T1057K, D1107N, F1117Y, N1291L, D908A, E993A, and D1263A; (3) a variant FnCpf1 that differs from a wild-type FnCpf1 sequence (SEQ ID NO:172) in containing at least one point mutation selected from the group consisting of I339P, L342F, Q588K, F1017Q, K1047E, N1118D, F1128Y, L867I, D917A, E1006A, and D1255A; and (4) a variant ObCsm1 sequence that differs from a wildtype ObCsm1 sequence (SEQ ID NO:137) in containing at least one point mutation selected from the group consisting of K382N, Q393K, S925A, E933N, K943F/Q, K972L, K1064G, P670I, N671I, D727A, E939A, and D1053A.

3. The engineered system of claim 2, wherein the Cas12a tracrRNA is provided:
(a) as DNA encoding a first RNA molecule comprising the Cas12a tracrRNA and comprising a restriction endonuclease cleavage site that is suitable for insertion of a sequence coding for a functional RNA moiety; or
(b) as a functional RNA molecule comprising the Cas12a tracrRNA and a functional RNA moiety, or as a polynucleotide encoding the functional RNA molecule; or
(c) by a DNA expression system comprising (i) DNA sequence for a first promoter; and (ii) operably linked and heterologous to the first promoter, DNA encoding a first RNA molecule comprising a Cas12a tracrRNA and comprising a restriction endonuclease cleavage site that is suitable for insertion of a sequence coding for a functional RNA moiety; and (iii) optionally, a terminator 3' to and operably linked to the DNA encoding the first RNA molecule; or
(d) by a DNA expression system comprising: (i) DNA sequence for a first promoter; and (ii) operably linked and heterologous to the first promoter, a DNA encoding a functional RNA molecule comprising a Cas12a tracrRNA and a functional RNA moiety; and (iii) optionally, a terminator 3' to and operably linked to the DNA encoding a functional RNA molecule; or
(e) as a Cas12a tracrRNA synthesized in vitro; or
(f) as a Cas12a tracrRNA obtained from a naturally occurring source.

4. The engineered system of claim 1, wherein the Cas12a tracrRNA is provided:
(a) in a molar excess, relative to the amount of Cas12a nuclease; or
(b) in a molar amount that is at least 10-fold greater than the molar amount of the Cas12a nuclease.

5. A delivery particle or delivery liquid comprising the engineered system of claim 1.

6. A method of modifying a target sequence in a locus of interest of a eukaryotic cell comprising delivering the engineered system of claim 5 to the locus of interest, wherein the spacer sequence hybridizes with the target sequence, whereby modification of the locus of interest occurs.

7. A method of producing a eukaryotic cell comprising a modification of a locus of interest comprising delivering the engineered system of claim 6 to a locus of interest, wherein the spacer sequence hybridizes with a target sequence located in the locus of interest of the eukaryotic cell and whereby the engineered system introduces the modification into the locus of interest.

8. The method of claim 7, further comprising isolating the eukaryotic cell comprising the modification of a locus of interest.

9. The method of claim 7, further comprising propagating the eukaryotic cell comprising the modification of the locus of interest.

10. The method of claim 7, further comprising introducing the eukaryotic cell comprising a modification of a locus of interest into a subject, optionally wherein the subject is a human or non-human mammal.

11. The method of claim 7, wherein the engineered system is delivered to a locus of interest in an unmodified eukaryotic cell obtained from a subject and wherein the eukaryotic cell comprising the modification of the locus of interest is introduced into the subject, optionally wherein the subject is a human or non-human mammal.

12. The method of claim 7, further comprising regenerating the eukaryotic cell comprising a modification of a locus of interest into an organism comprising the modification of the locus of interest.

13. The method of claim 12, wherein the organism is a plant, optionally wherein the plant is a maize, soybean, wheat, rice, cotton, or *Brassica* sp. plant, and optionally further comprising propagating the plant or harvesting seed therefrom.

14. The method of claim 7, wherein the modification is selected from the group consisting of an insertion of one or more nucleotides, a deletion of one or more nucleotides, or a substitution of one or more nucleotides.

15. The method of claim 7, wherein the eukaryotic cell is a non-human mammalian cell, a plant cell, or a fungal cell.

16. The method of claim 7, wherein the eukaryotic cell is an isolated cell in an in vitro axenic culture.

17. The method of claim 16, wherein the isolated cell is a human cell.

* * * * *